United States Patent
Kufer et al.

(10) Patent No.: US 11,987,633 B2
(45) Date of Patent: *May 21, 2024

(54) CROSS-SPECIES-SPECIFIC SINGLE DOMAIN BISPECIFIC SINGLE CHAIN ANTIBODY

(71) Applicant: AMGEN RESEARCH (MUNICH) GMBH, Munich (DE)

(72) Inventors: Peter Kufer, Munich (DE); Tobias Raum, Munich (DE); Roman Kischel, Munich (DE); Ralf Lutterbüse, Munich (DE); Patrick Hoffmann, Munich (DE); Matthias Klinger, Munich (DE); Doris Rau, Munich (DE); Susanne Mangold, Munich (DE)

(73) Assignee: AMGEN RESEARCH (MUNICH) GMBH, Munich (DE)

( * ) Notice: Subject to any disclaimer, the term of this patent is extended or adjusted under 35 U.S.C. 154(b) by 208 days.

This patent is subject to a terminal disclaimer.

(21) Appl. No.: 17/204,166

(22) Filed: Mar. 17, 2021

(65) Prior Publication Data

US 2022/0041736 A1    Feb. 10, 2022

Related U.S. Application Data

(63) Continuation of application No. 13/122,280, filed as application No. PCT/EP2009/062795 on Oct. 1, 2009, now Pat. No. 10,981,998.

(60) Provisional application No. 61/101,935, filed on Oct. 1, 2008.

(51) Int. Cl.
*C07K 16/18* (2006.01)
*C07K 16/28* (2006.01)

(52) U.S. Cl.
CPC ...... *C07K 16/2863* (2013.01); *C07K 16/2803* (2013.01); *C07K 16/2878* (2013.01); *C07K 16/2884* (2013.01); *C07K 2317/31* (2013.01); *C07K 2317/34* (2013.01)

(58) Field of Classification Search
CPC .......................... C07K 16/18; C07K 16/2863; C07K 16/2803; C07K 16/2878; C07K 16/2884
USPC ..................................... 424/133.1; 530/387.3
See application file for complete search history.

(56) References Cited

U.S. PATENT DOCUMENTS

| | | |
|---|---|---|
| 9,243,058 B2 | 1/2016 | Armitage et al. |
| 10,220,090 B2 | 3/2019 | Armitage et al. |
| 10,294,300 B2 | 5/2019 | Raum et al. |
| 10,301,391 B2 | 5/2019 | Raum et al. |
| 10,519,241 B2 | 12/2019 | Raum et al. |
| 10,683,351 B2 | 6/2020 | Raum et al. |
| 10,781,264 B2 | 9/2020 | Raum et al. |
| 10,981,998 B2 * | 4/2021 | Kufer ............... C07K 16/2803 |
| 2010/0150918 A1 | 6/2010 | Kufer et al. |
| 2010/0183615 A1 | 7/2010 | Kufer et al. |
| 2011/0293619 A1 | 12/2011 | Kufer et al. |
| 2012/0034228 A1 | 2/2012 | Kufer et al. |
| 2012/0244162 A1 | 9/2012 | Kufer et al. |
| 2013/0129730 A1 | 5/2013 | Kufer et al. |
| 2014/0322218 A1 | 10/2014 | Xiao et al. |
| 2015/0368343 A1 | 12/2015 | Xiao et al. |
| 2016/0032019 A1 | 2/2016 | Xiao et al. |
| 2016/0152707 A1 | 6/2016 | Kufer et al. |
| 2017/0029502 A1 | 2/2017 | Raum et al. |
| 2017/0037149 A1 | 2/2017 | Raum et al. |
| 2017/0073415 A1 | 3/2017 | Urech et al. |

(Continued)

FOREIGN PATENT DOCUMENTS

| | | |
|---|---|---|
| WO | WO-2004/003019 A2 | 1/2004 |
| WO | WO-2004/106380 A2 | 12/2004 |

(Continued)

OTHER PUBLICATIONS

Krakow et al (Antib Ther. 5(1):1-10 (Dec. 16, 2021); doi: 10.1093/abt/tbab028. eCollection Jan. 2022).*

(Continued)

*Primary Examiner* — Lynn A Bristol
(74) *Attorney, Agent, or Firm* — MARSHALL, GERSTEIN & BORUN LLP

(57) ABSTRACT

The present invention relates to a bispecific single chain antibody molecule comprising a first binding domain consisting of one antibody variable domain capable of binding to an epitope of the human and non-chimpanzee primate CD3 epsilon chain, wherein the epitope is part of an amino acid sequence comprised in the group consisting of SEQ ID NOs. 2, 4, 6, and 8, and a second binding domain capable of binding to an epitope of a human and a non-chimpanzee primate tumor target antigen. The invention further relates to a bispecific single chain antibody molecule comprising a first binding domain capable of binding to an epitope of human and non-chimpanzee primate CD3ε (epsilon) chain, wherein the epitope is part of an amino acid sequence comprised in the group consisting of SEQ ID NOs. 2, 4, 6, and 8, and a second binding domain consisting of one antibody variable domain capable of binding to an epitope of a human and a non-chimpanzee primate tumor target antigen. The invention also provides nucleic acids encoding said bispecific single chain antibody molecule as well as vectors and host cells and a process for its production. The invention further relates to pharmaceutical compositions comprising said bispecific single chain antibody molecule and medical uses of said bispecific single chain antibody molecule.

27 Claims, 96 Drawing Sheets

Figure 1:
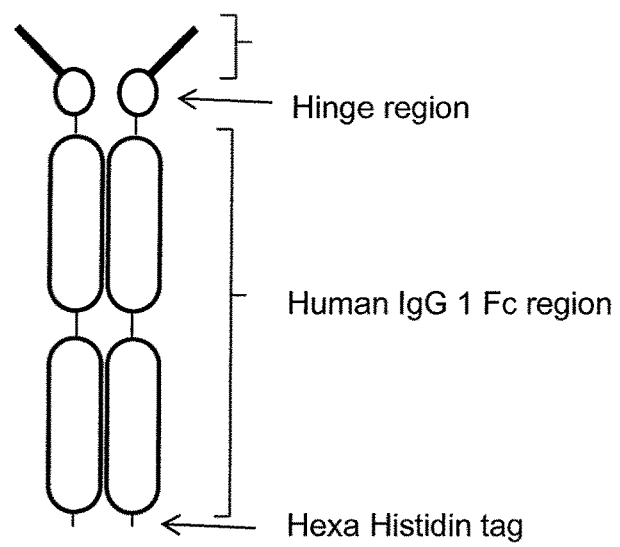

Specification includes a Sequence Listing.

(56) References Cited

U.S. PATENT DOCUMENTS

| | | | |
|---|---|---|---|
| 2017/0129961 A1 | 5/2017 | Raum et al. | |
| 2017/0218078 A1 | 8/2017 | Raum et al. | |
| 2019/0016805 A1 | 1/2019 | Xiao et al. | |
| 2020/0048357 A1 | 2/2020 | Raum et al. | |
| 2020/0071405 A1 | 3/2020 | Xiao et al. | |
| 2020/0332002 A1 | 10/2020 | Raum et al. | |
| 2023/0406927 A1* | 12/2023 | Wagner | A61P 35/00 |

FOREIGN PATENT DOCUMENTS

| | | |
|---|---|---|
| WO | WO-2004/106381 A1 | 12/2004 |
| WO | WO-2007/042261 A2 | 4/2007 |
| WO | WO-2008/119565 A2 | 10/2008 |
| WO | WO-2008/119566 A2 | 10/2008 |
| WO | WO-2008/119567 A2 | 10/2008 |

OTHER PUBLICATIONS

Schaller et al (J Immunother Cancer (1):e000213; Apr. 2020;8; doi: 10.1136/jitc-2019-000213).*

Fredrich et al (Mol Cancer Ther (2014) 13 (6): 1549-1557).*

Bargou et al., Tumor regression in cancer patients by very low doses of a T cell-engaging antibody, *Science*. 21:974-77 (2008).

Brorson et al., Mutational analysis of avidity and fine specificity of anti-levan antibodies, *J. Immunol*. 163:6694-701 (1999).

Brummell et al., Probing the combining site of an anti-carbohydrate antibody by saturation-mutagenesis: role of the heavy-chain CDR3 residues, *Biochemistry*. 32:1180-7 (1993).

Burks et al., In vitro scanning saturation mutagenesis of an antibody binding pocket, *PNAS*. 94:412-7 (1997).

Casset et al., A peptide mimetic of an anti-CD4 monoclonal antibody by rational design, *Biochem. Biophys. Res. Commun*. 307:198-205 (2003).

Chen et al., Selection and analysis of an optimized anti-VEGF antibody: crystal structure of an affinity-matured Fab in complex with antigen, *J. Mol. Biol*. 293:865-81 (1999).

ClinicalTrials.gov Archive, View of NCT00560794 on Aug. 11, 2008, Phase II Study of the BiTE Blinatumomab (MT103) in Patients With Minimal Residual Disease of B-Precurser Acute ALL, 3 pages.

Colman, Effects of amino acid sequence changes on antibody-antigen interactions, *Research in Immunol*. 145:33-36 (1994).

International Search Report and Written Opinion from the corresponding International Application PCT/EP2009/062795, dated May 20, 2010.

De Genst et al., Antibody repertoire development in camelids, *Dev. Comp. Immunol*. 30:187-98 (2006).

De Pascalis et al., Grafting of "abbreviated" complementarity-determining regions containing specificity-determining residues essential for ligand contact to engineer a less immunogenic humanized monoclonal antibody, *J. Immunol*. 169:3076-84 (2002).

First Office for EP 09783665.4, dated Jun. 27, 2012.

Holm et al., Functional mapping and single chain construction of the anti-cytokeratin 8 monoclonal antibody TS1, *Mol. Immunol*. 44:1075-84 (2007).

Initial sequence of the chimpanzee genome and comparison with the human genome, *Nature*. 37:69-85 (2005).

Jang et al., The structural basis for DNA binding by an anti-DNA autoantibody, *Mol. Immunol*. 35:1207-17 (1998).

Kim et al., Mutational approaches to improve the biophysical properties of human single-domain antibodies, *Biochim. Biophys. Acta*. 1844:1983-2001 (2014).

Kobayashi et al., Tryptophan H33 plays an important role in pyrimidine (6-4) pyrimidone photoproduct binding by a high-affinity antibody, *Protein Engineering*. 12:879-84 (1999).

Kumar et al., Molecular cloning and expression of the Fabs of human autoantibodies in *Escherichia coli*. Determination of the heavy or light chain contribution to the anti-DNA/-cardiolipin activity of the Fab, *J. Biol. Chem*. 275:35129-36 (2000).

MacCallum et al., Antibody-antigen interactions: contact analysis and binding site topography, Antibody-antigen interactions: contact analysis and binding site topography, *J. Mol. Biol*. 262:732-45 (1996).

Maletz et al., Bispecific single-chain antibodies as effective tools for eliminating epithelial cancer cells from human stem cell preparations by redirected cell cytotoxicity, *Int. J. Cancer*. 93:409-16 (2001).

Merriam-Webster definition of "capable" (pp. 1-9; Oct. 8, 2018).

Pessano et al., The T3/T cell receptor complex: antigenic distinction between the two 20-kd T3 (T3-delta and T3-epsilon) subunits, *EMBO J*. 4:337-344 (1985).

Rudikoff et al., Single amino acid substitution altering antigen-binding specificity, *Proc. Natl. Acad. Sci. USA*. 79:1979-83 (1982).

Smith-Gill et al., Contributions of immunoglobulin heavy and light chains to antibody specificity for lysozyme and two haptens, *J. Immunol*. 139:4135-44 (1987).

Song et al., Light chain of natural antibody plays a dominant role in protein antigen binding, *Biochem. Biophys. Res. Commun*. 268:390-4 (2000).

Vajdos et al., Comprehensive functional maps of the antigen-binding site of an anti-ErbB2 antibody obtained with shotgun scanning mutagenesis, *J. Mol. Biol*. 320:415-28 (2002).

Ward et al., Binding activities of a repertoire of single immunoglobulin variable domains secreted from *Escherichia coli*, *Nature*. 341:544-6 (1989).

Wolf et al., BiTEs: bispecific antibody constructs with unique anti-tumor activity, *Drug Discov. Today*. 10:1237-44 (2005).

Wu et al., Humanization of a murine monoclonal antibody by simultaneous optimization of framework and CDR residues, *J. Mol. Biol*. 294:151-62 (1999).

* cited by examiner

Figure 13
A)
Effector cells: stimulated CD4/CD56 depleted human PBMC
Target cells: CHO transfected with human MCSP D3
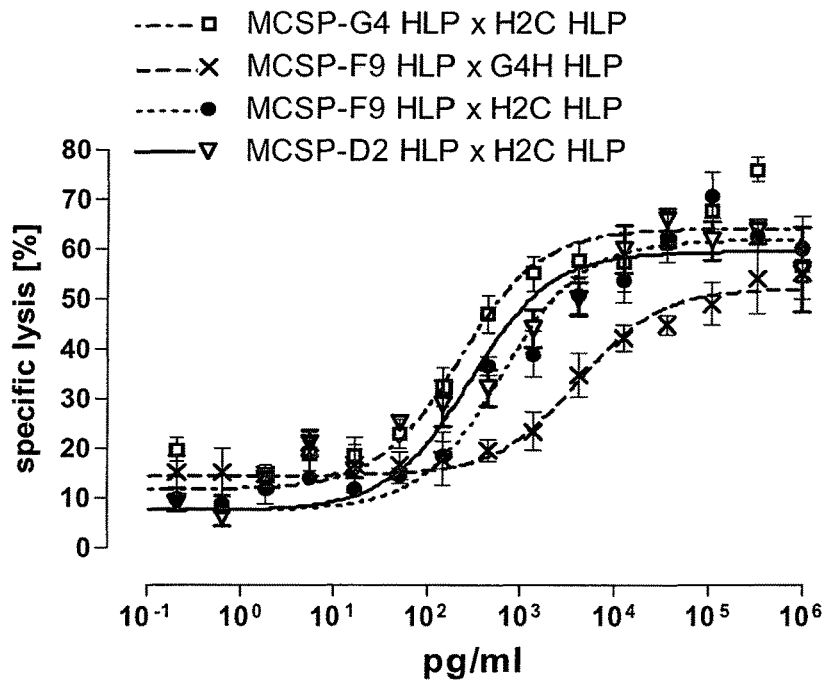
B)
Effector cells: macaque T cell line 4119 LnPx
Target cells: CHO transfected with cynomolgus MCSP D3
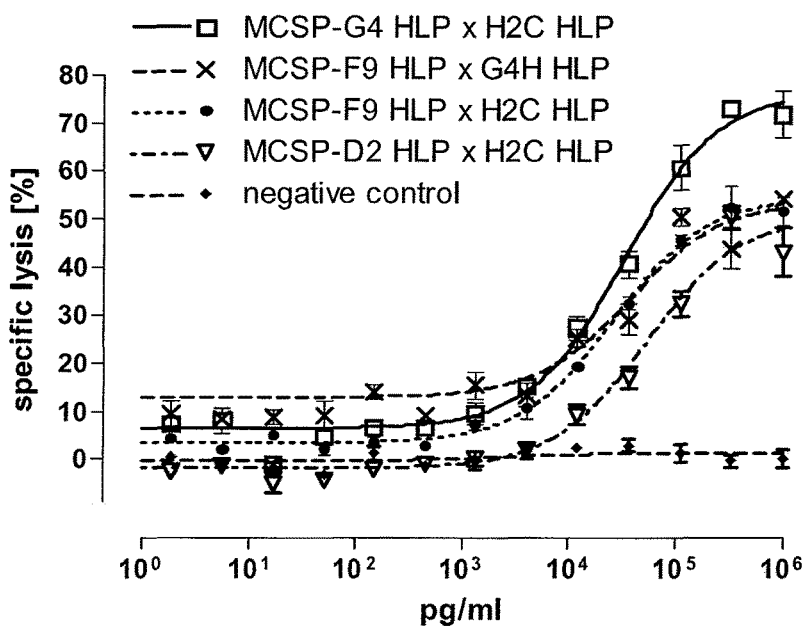

Figure 14
A)
Effector cells: macaque T cell line 4119 LnPx
Target cells: CHO transfected with cynomolgus MCSP D3
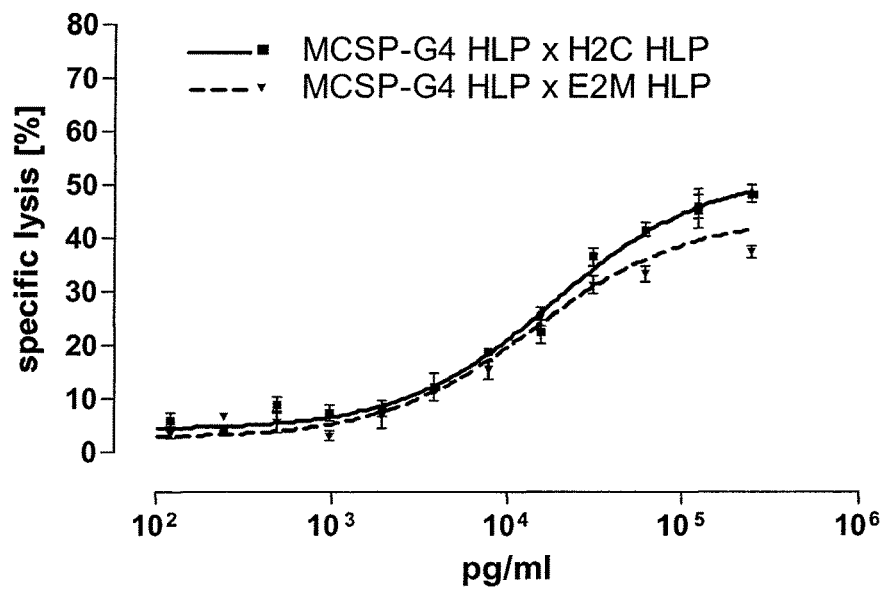
B)
Effector cells: macaque T cell line 4119 LnPx
Target cells: CHO transfected with cynomolgus MCSP D3
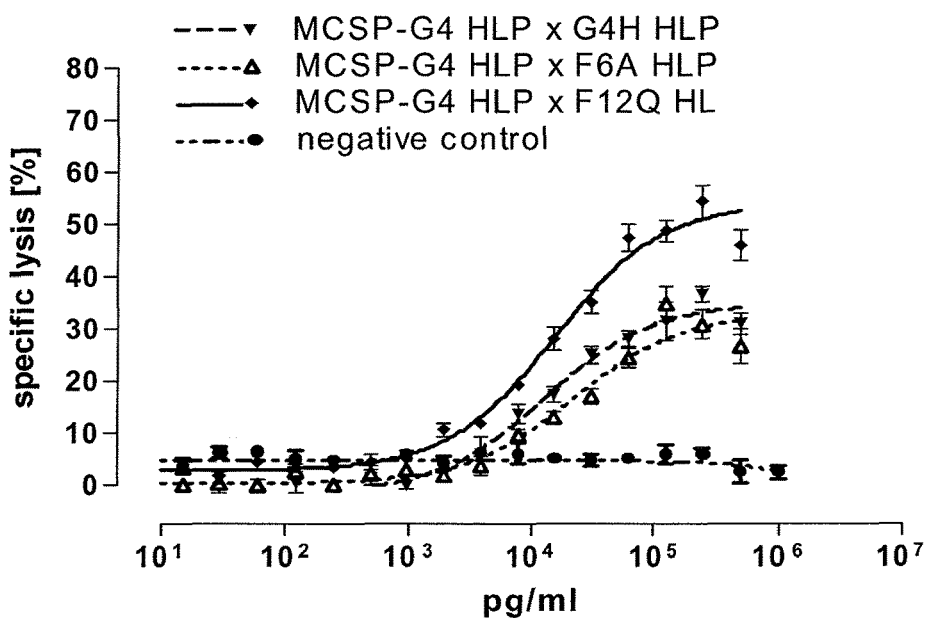

Figure 15
A)
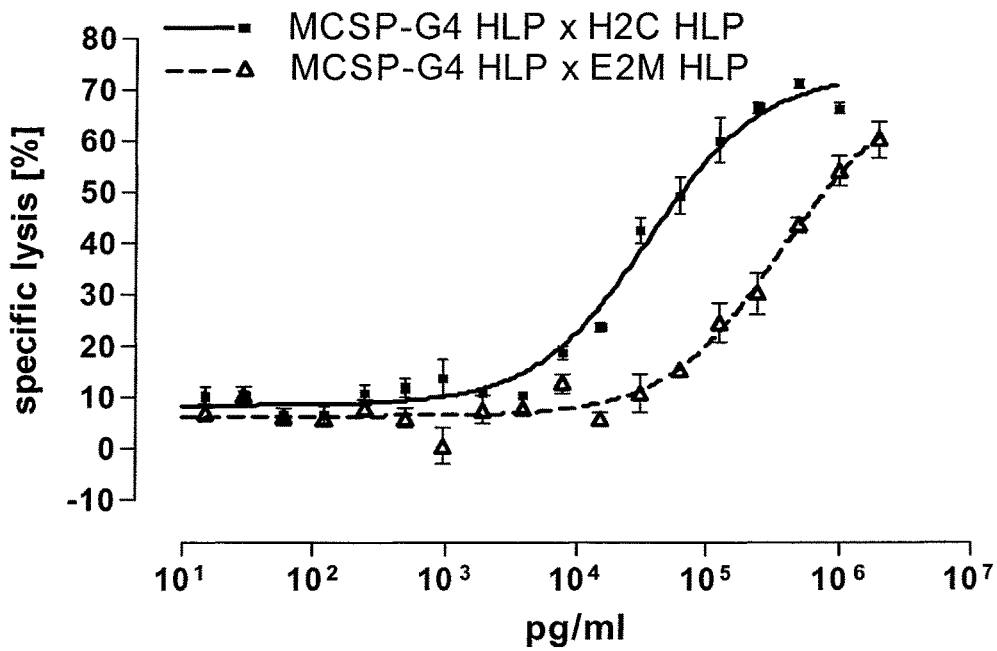
B)
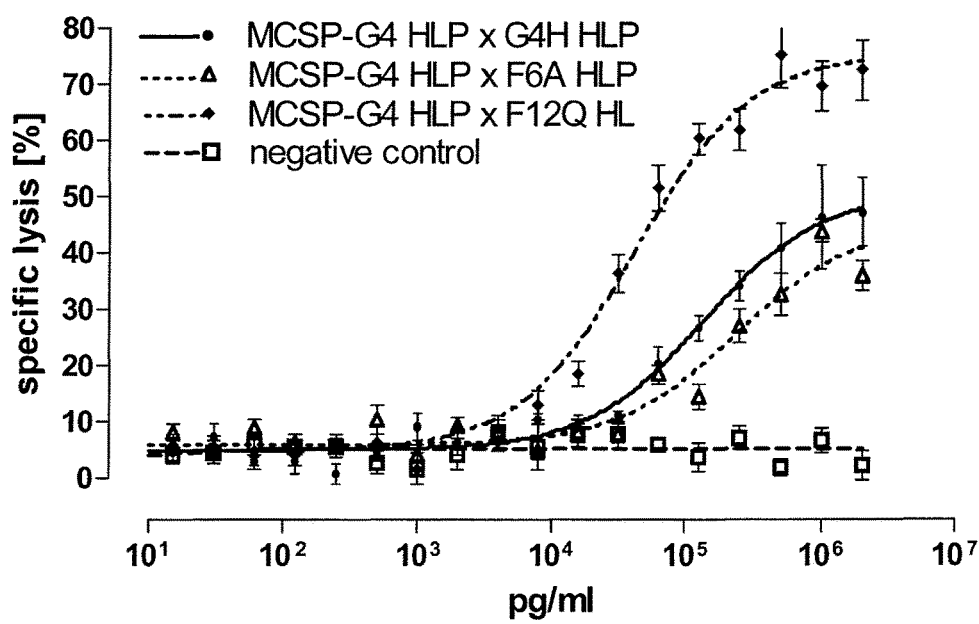

Figure 16
A)
Effector cells: stimulated CD4/CD56 depleted human PBMC
Target cells: CHO transfected with human MCSP D3
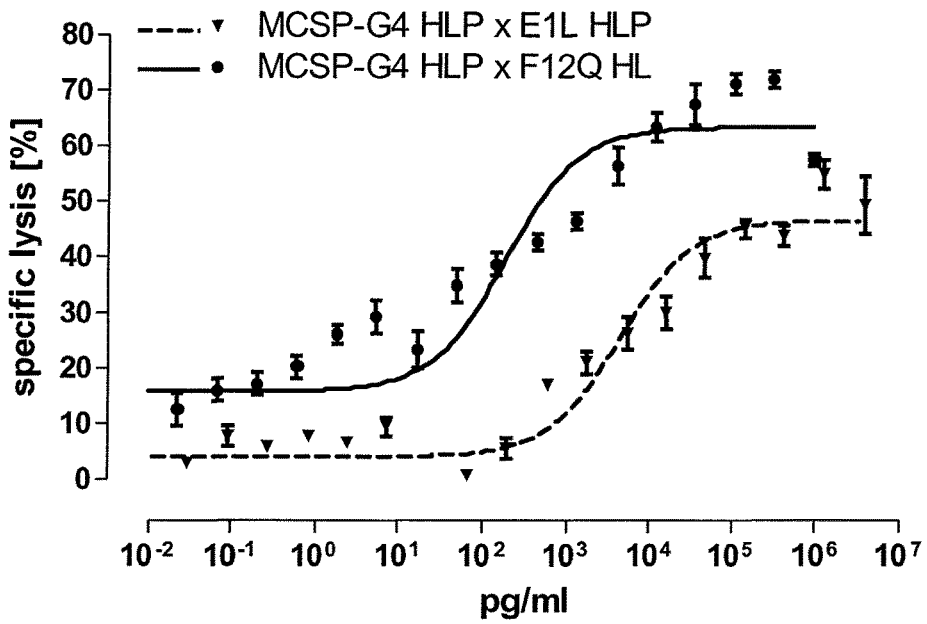
B)
Effector cells: macaque T cell line 4119 LnPx
Target cells: CHO transfected with cynomolgus MCSP D
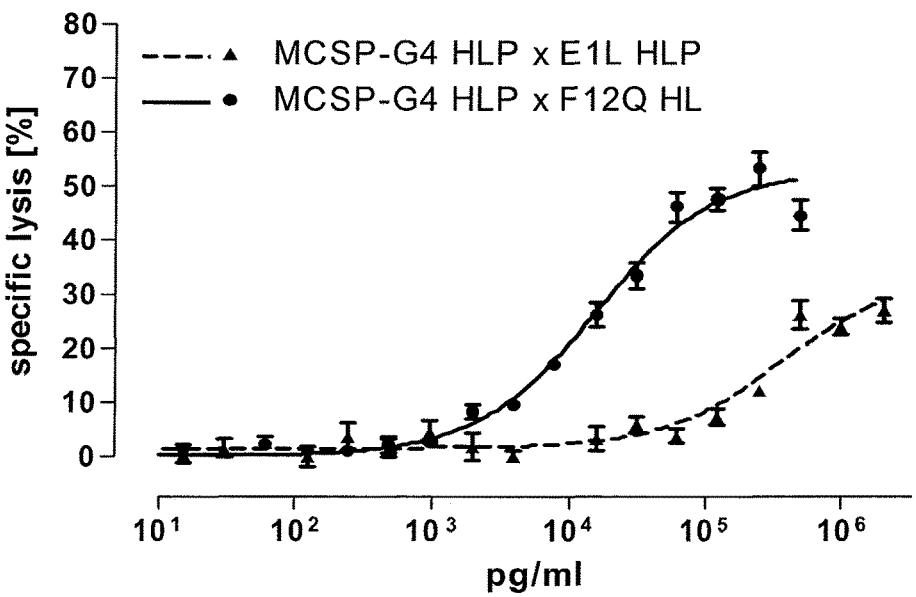

Figure 17
A)
Effector cells: stimulated CD4/CD56 depleted human PBMC
Target cells: CHO transfected with human MCSP D3
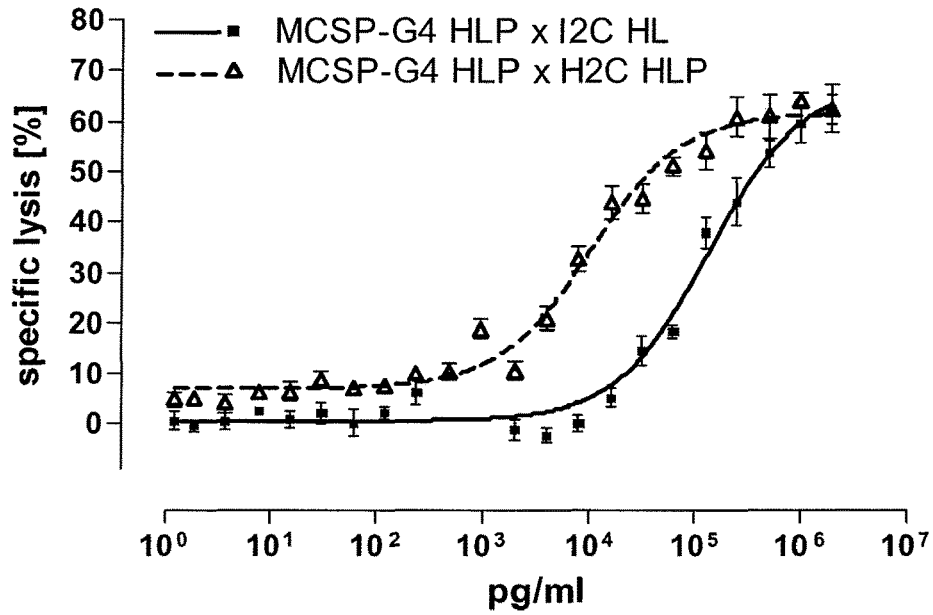
B)
Effector cells: macaque T cell line 4119 LnPx
Target cells: CHO transfected with cynomolgus MCSP D3
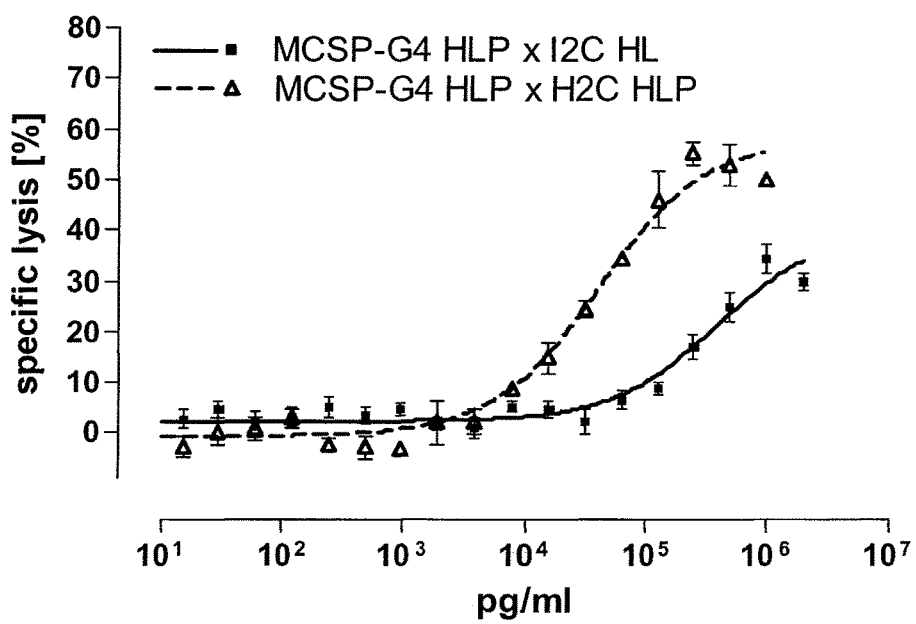

Pat. 31 (30 µg/m$^2$/24h CD19xCD3)

Pat. 33 (60 µg/m$^2$/24h CD19xCD3)

Figure 20
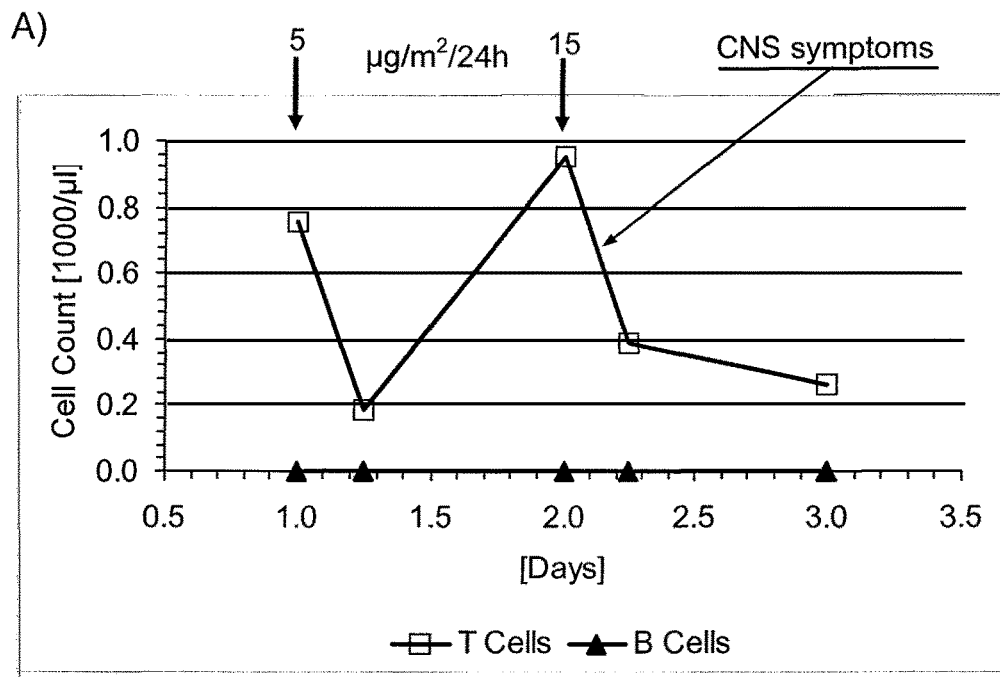
Pat. 19 (continuous infusion: 5 μg/m²/24h for 1 day followed by 15 μg/m²/24h CD19xCD3 maintenance)
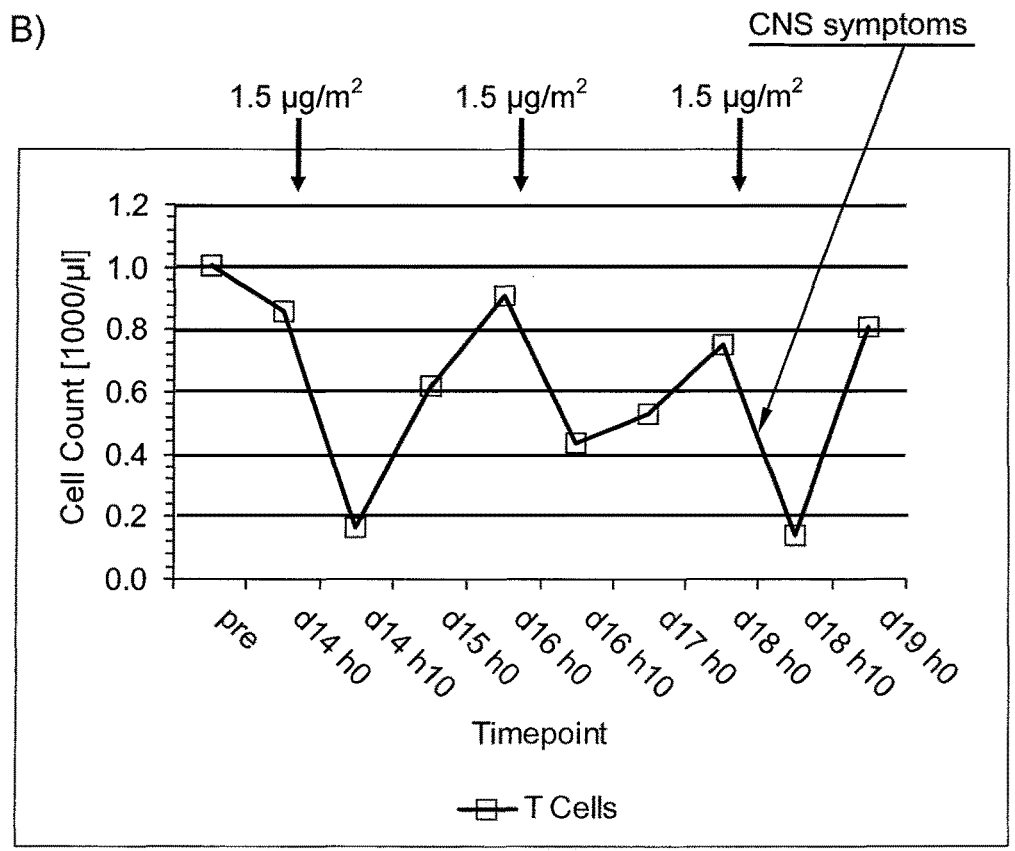
Pat. 003002 (bolus infusion trial)

Figure 23
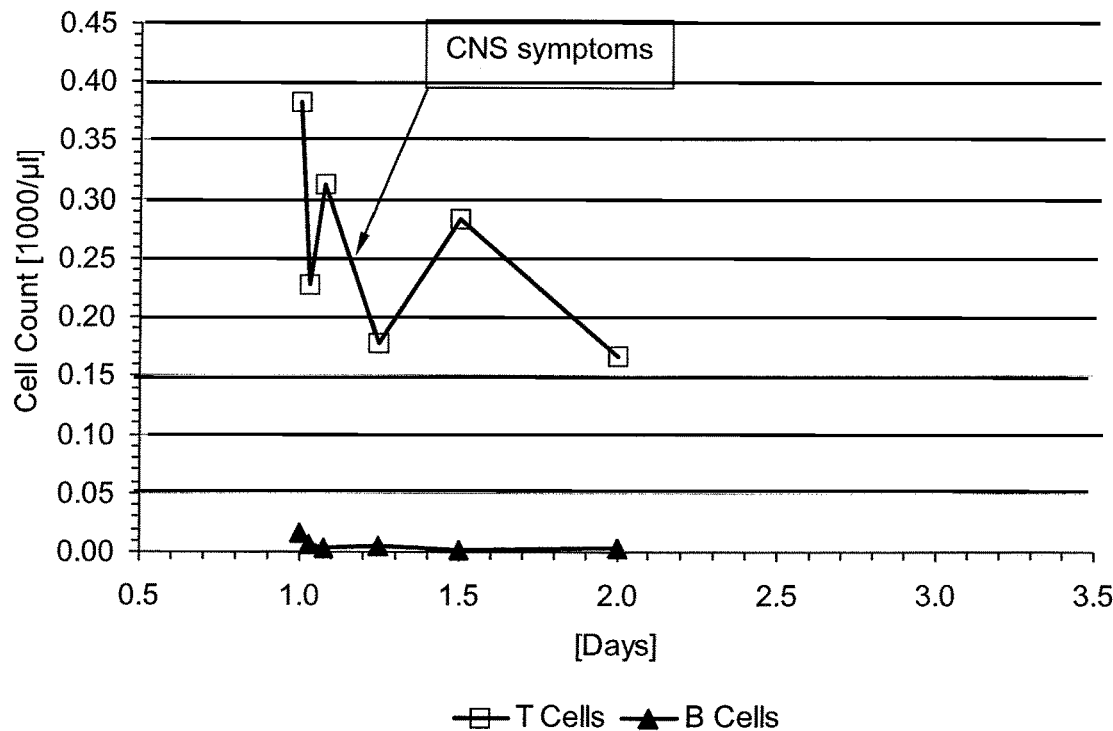
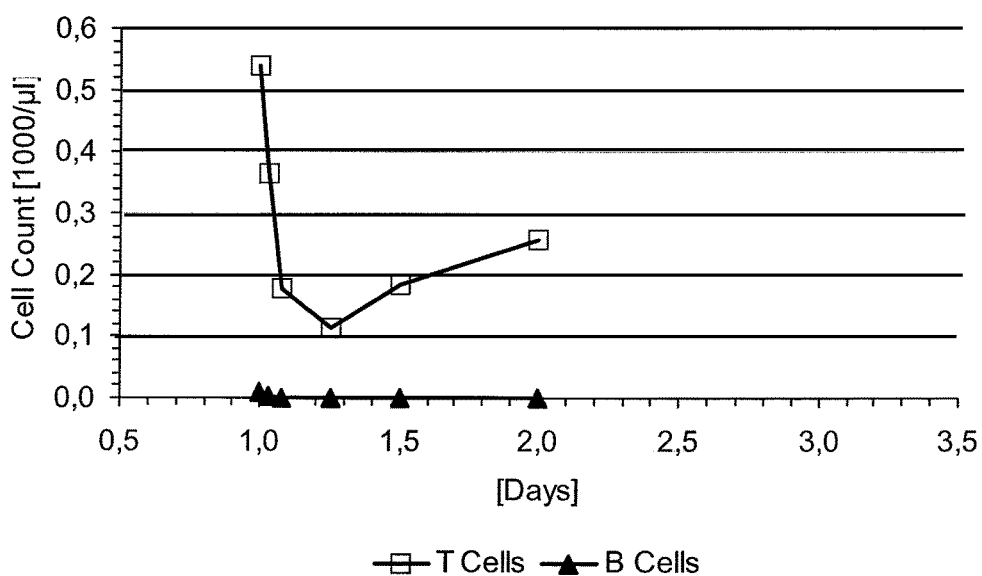

Model of T cell adhesion to endothelial cells induced by monovalent binding to context dependent CD3 epitopes

Dose- and time-dependent depletion of blood CD33-monocytes through CD33-AF5 VH-VL x I2C VH-VL

Figure 28A
Animal 1 (60 µg/m$^2$/24h MCSP-G4 VH-VL x I2C VH-VL )
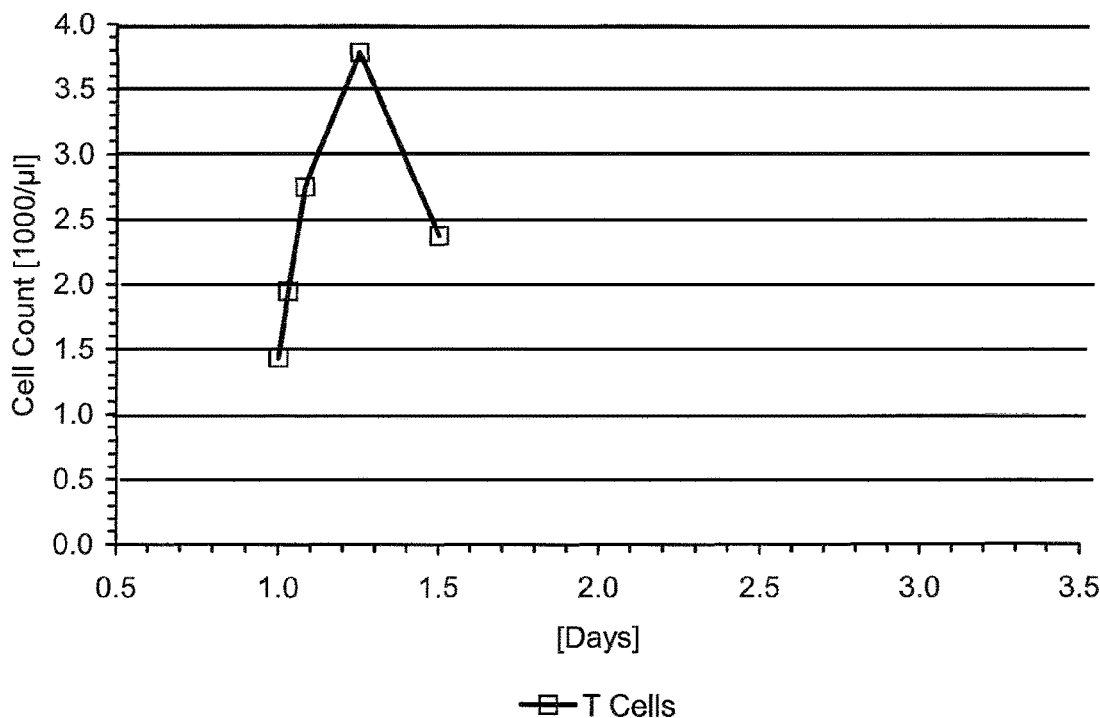
Animal 2 (240 µg/m$^2$/24h MCSP-G4 VH-VL x I2C VH-VL)
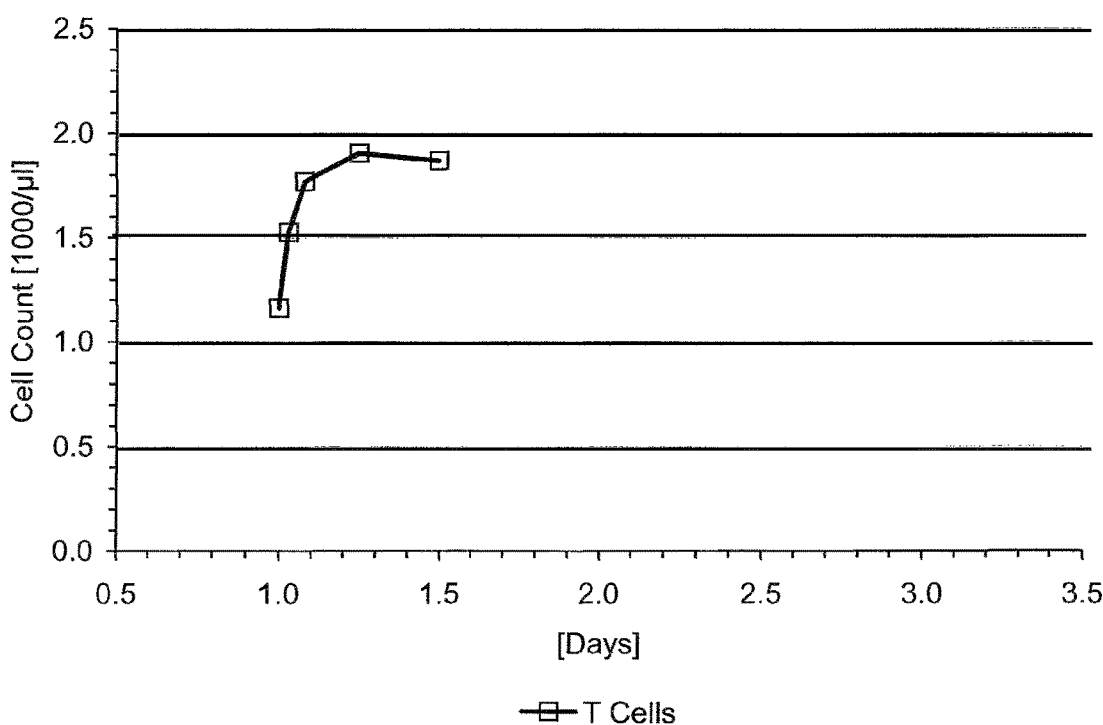

Figure 28B
Animal 3 (240 μg/m²/24h MCSP-G4 VH-VL x I2C VH-VL)
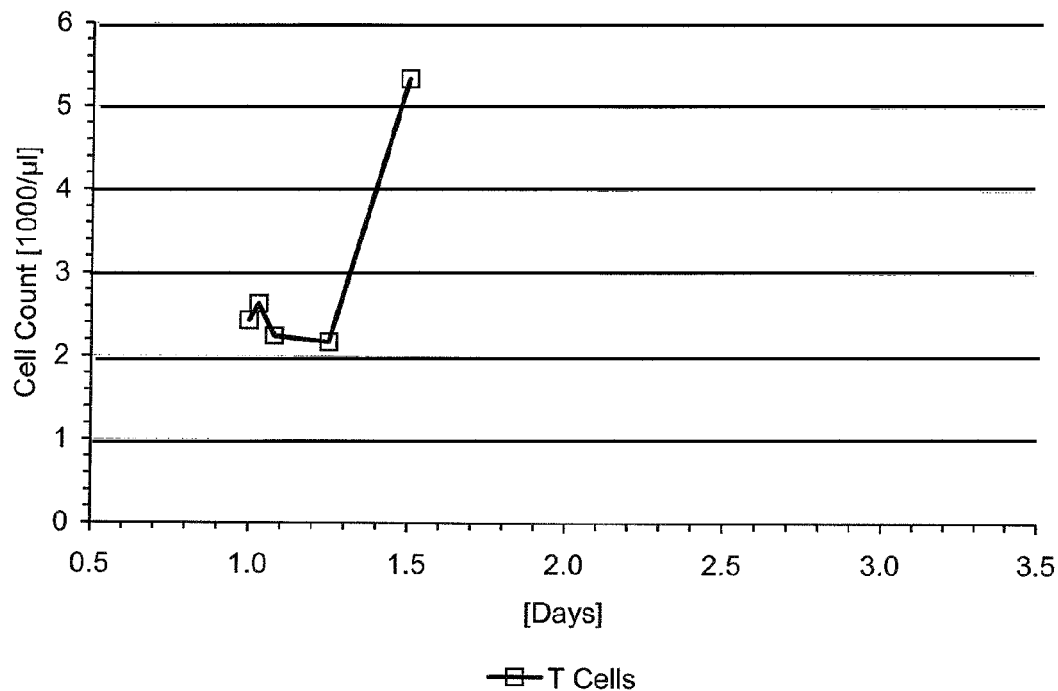
Animal 4 (1000 μg/m²/24h MCSP-G4 VH-VL x I2C VH-VL)
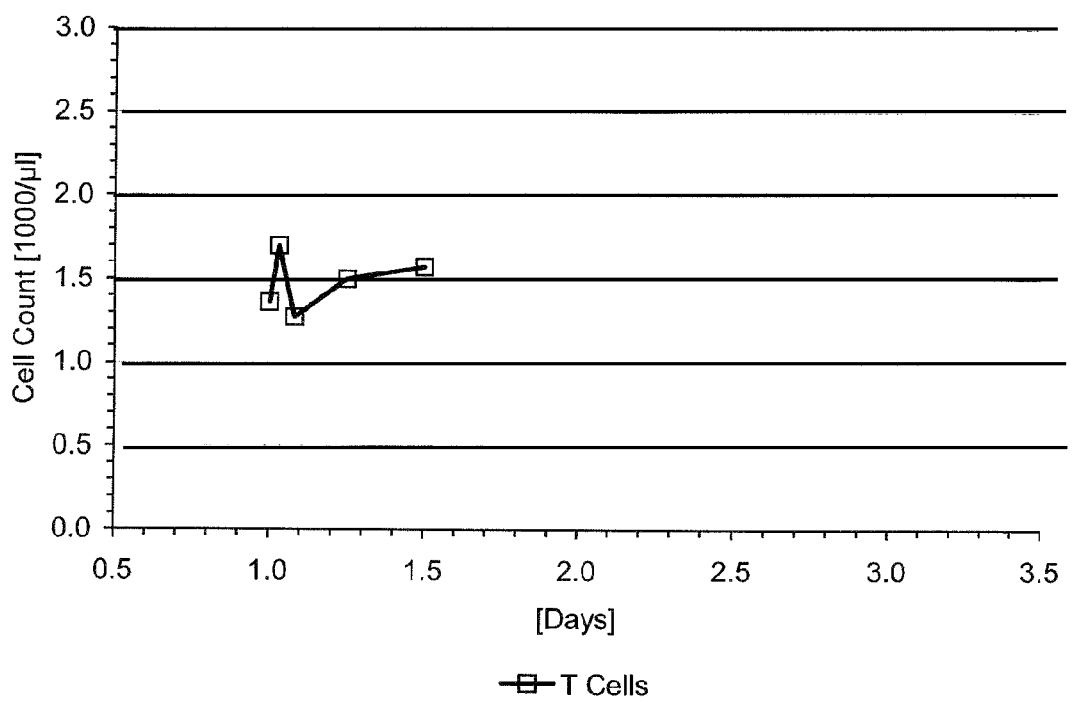

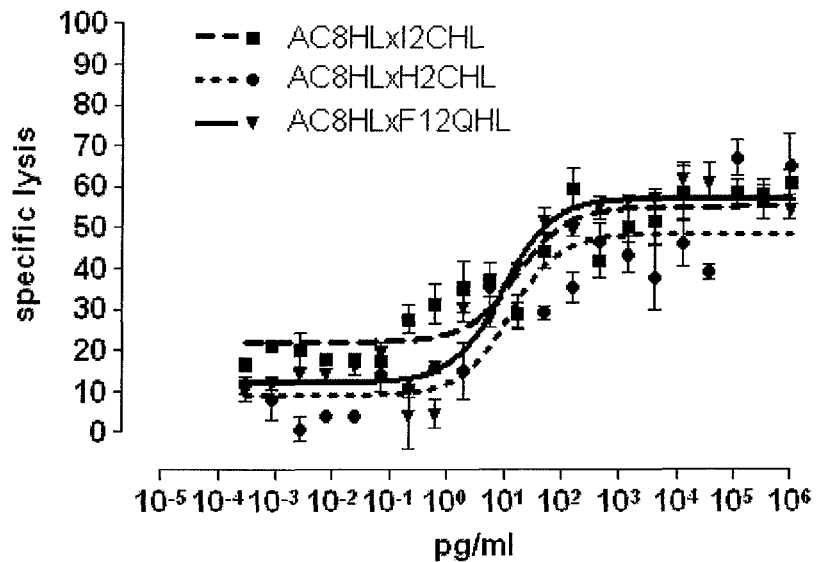
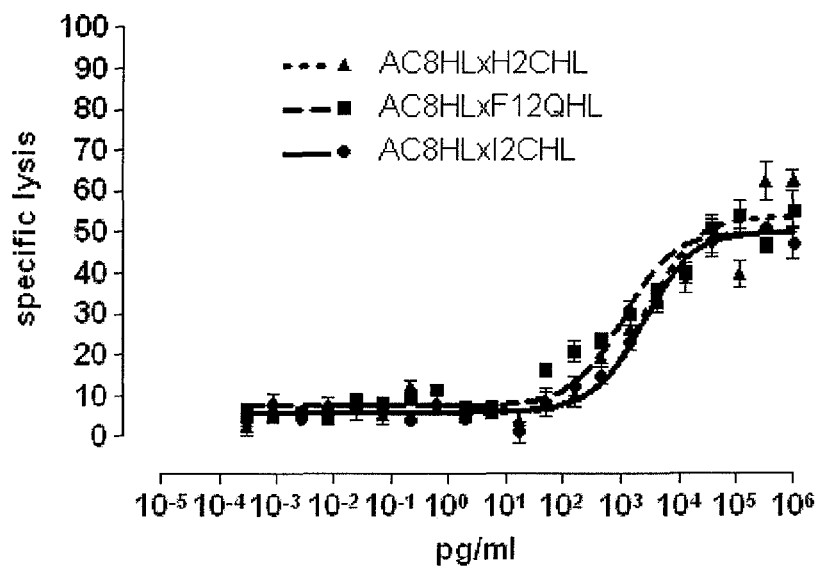
Figure 30A

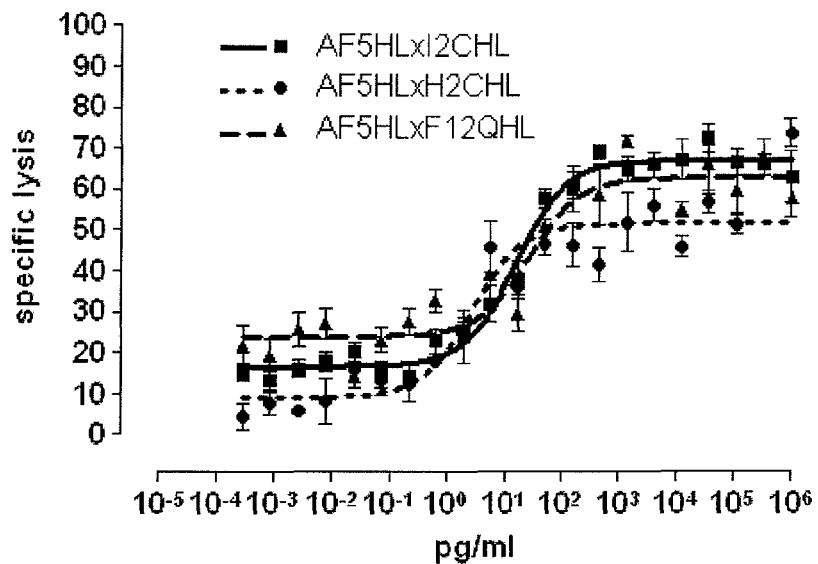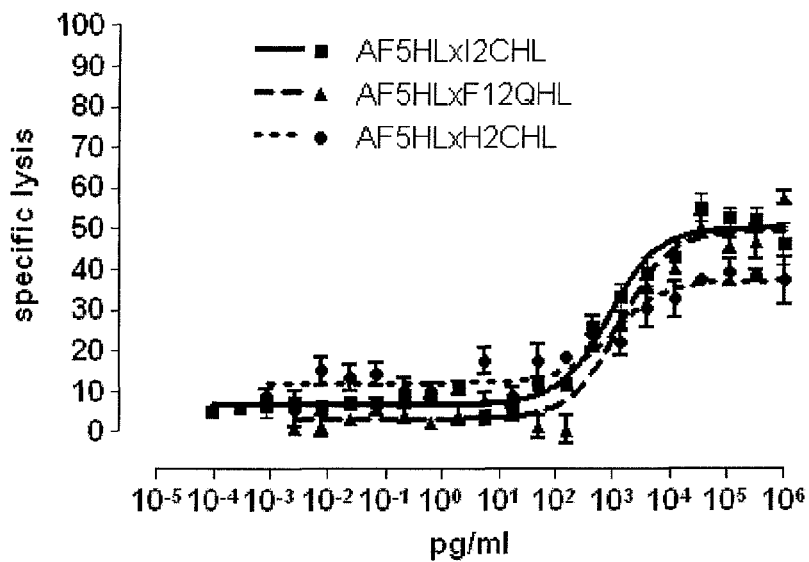
Figure 30B

Effector cells: stimulated CD4/CD56 depleted human PBMC
Target cells: CHO transfected with human CD33
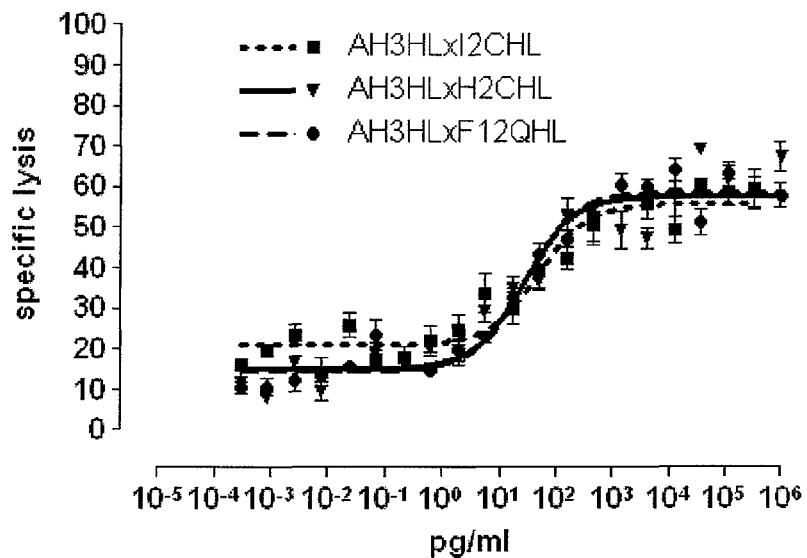
Effector cells: macaque 4119 LnPx
Target cells: CHO transfected with macaque CD33
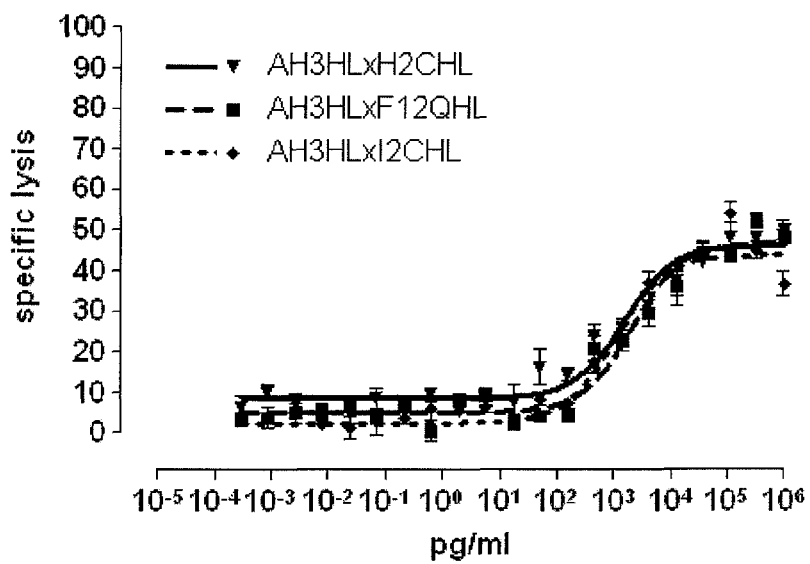
Figure 30C

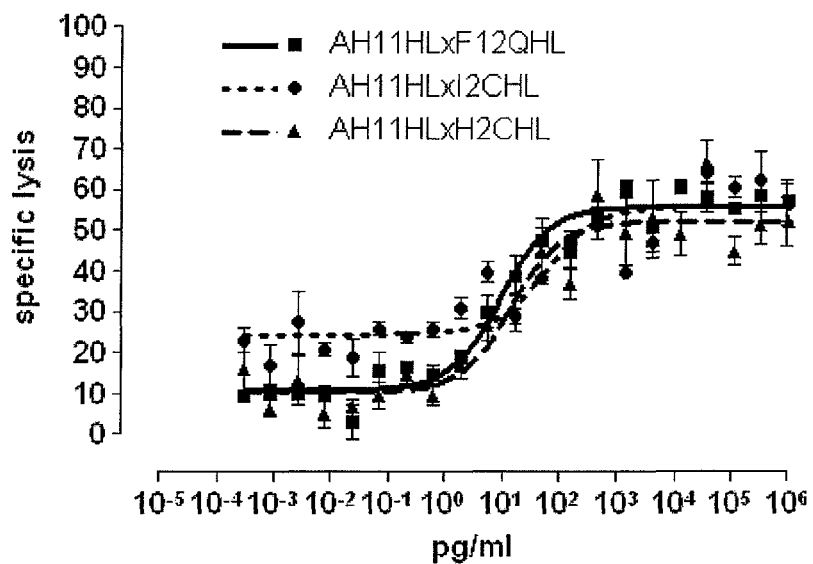
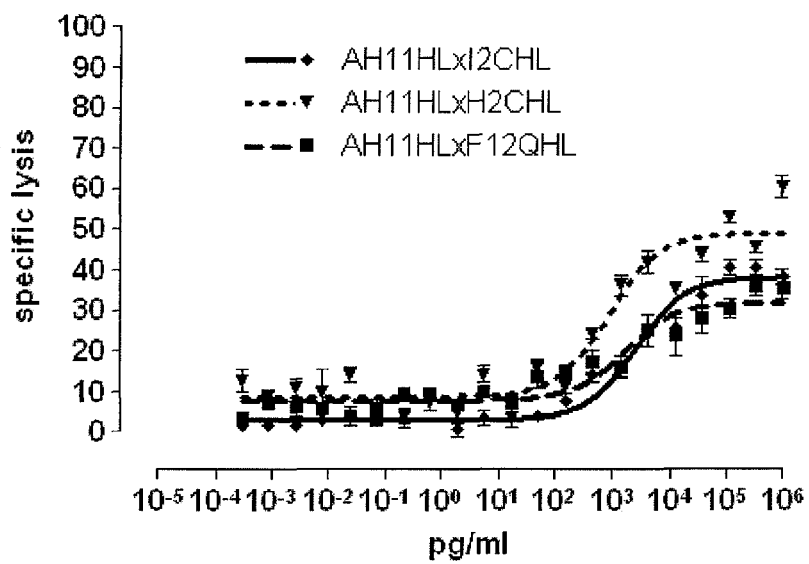
Figure 30D

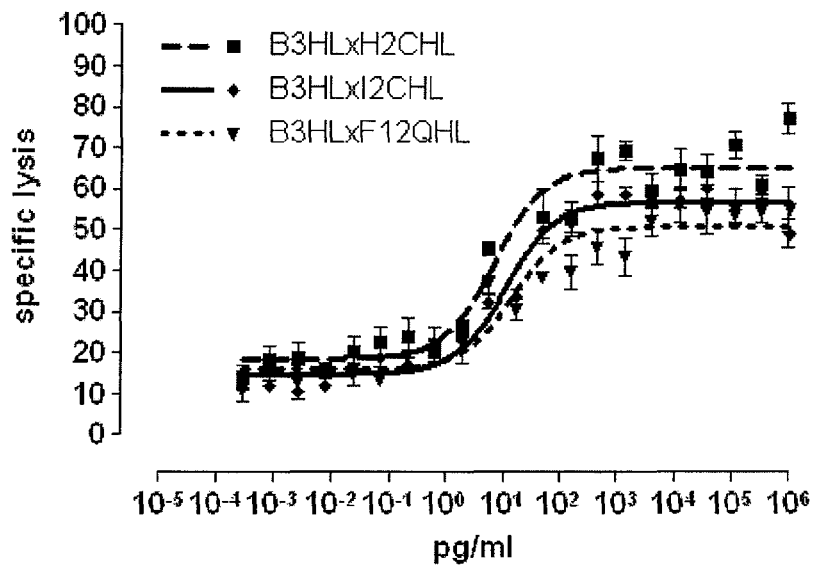
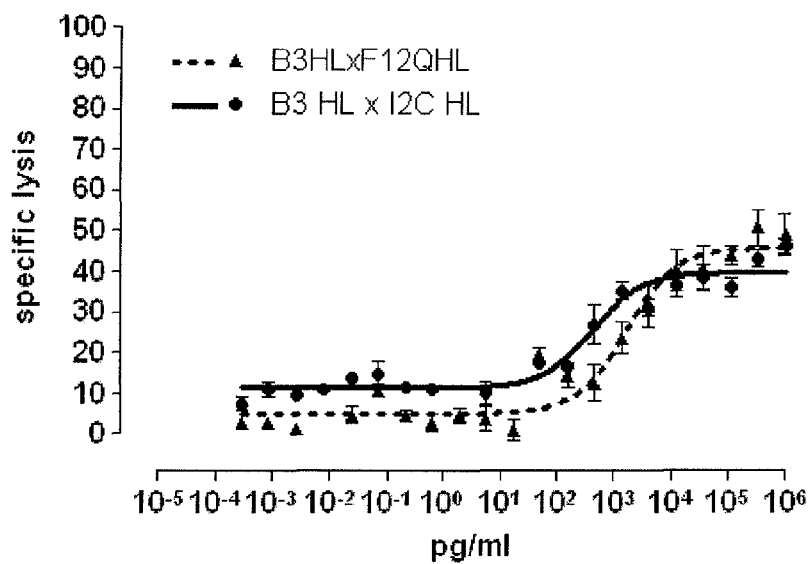
Figure 30E

Effector cells: stimulated CD4/CD56 depleted human PBMC
Target cells: CHO transfected with human CD33
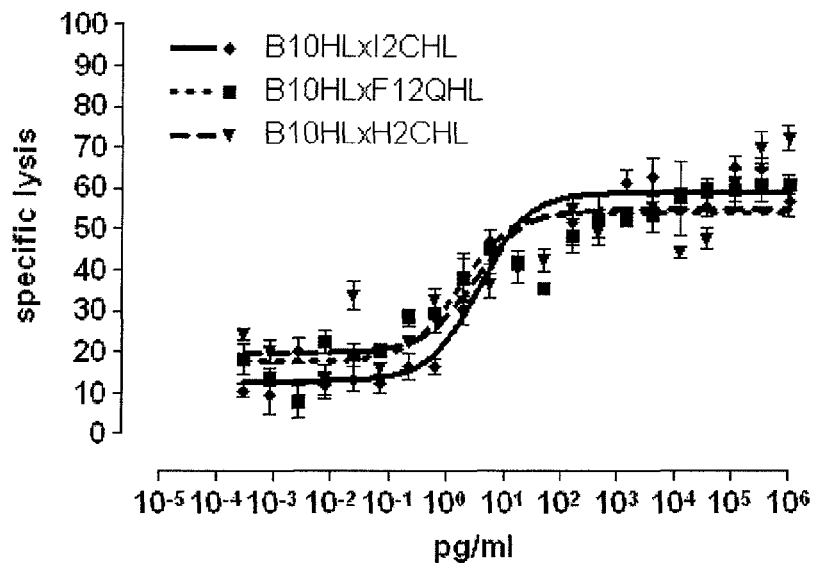
Effector cells: macaque 4119 LnPx
Target cells: CHO transfected with macaque CD33
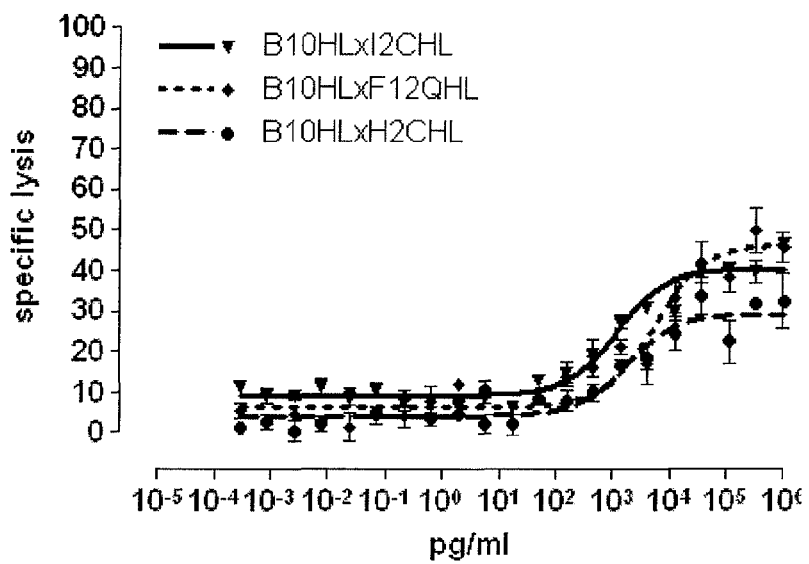
Figure 30F

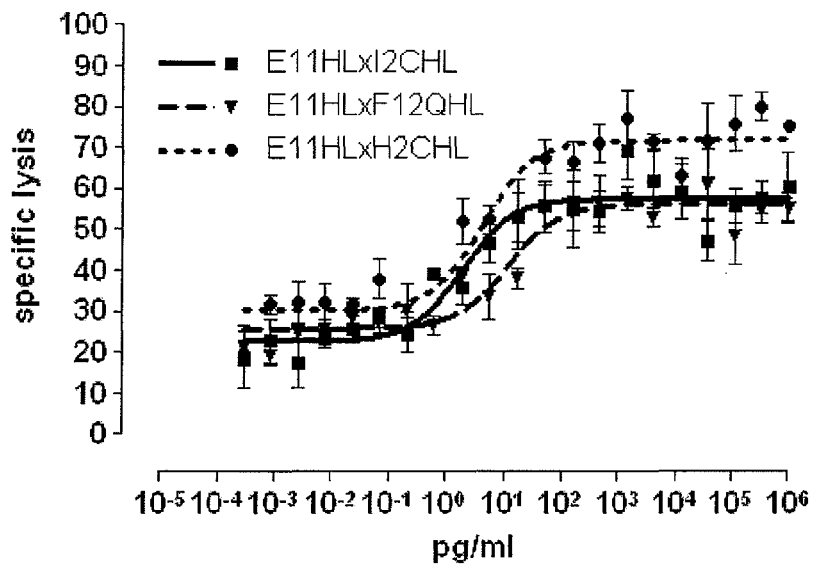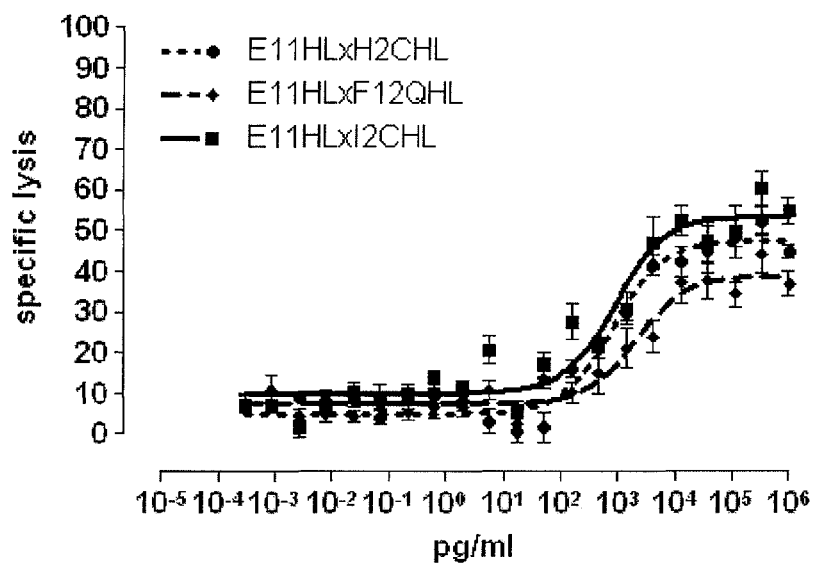
Figure 30G

Effector cells: stimulated CD4/CD56 depleted human PBMC
Target cells: CHO transfected with human CD33
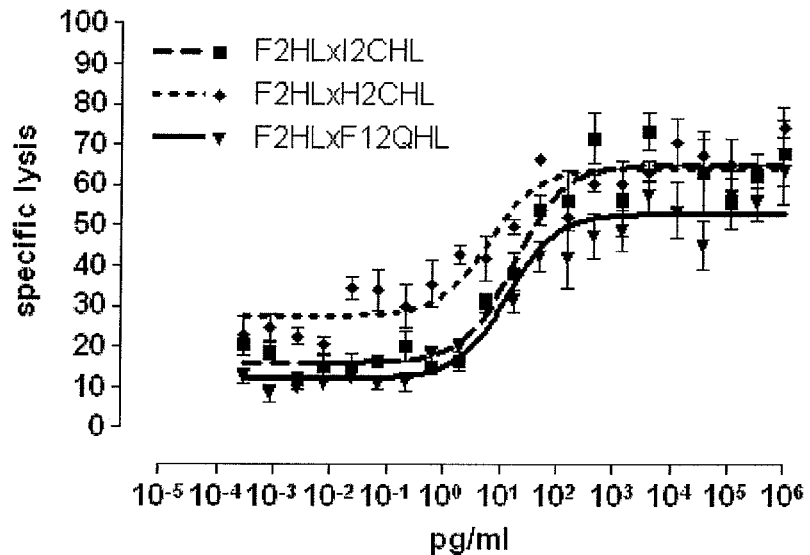
Effector cells: macaque 4119 LnPx
Target cells: CHO transfected with macaque CD33
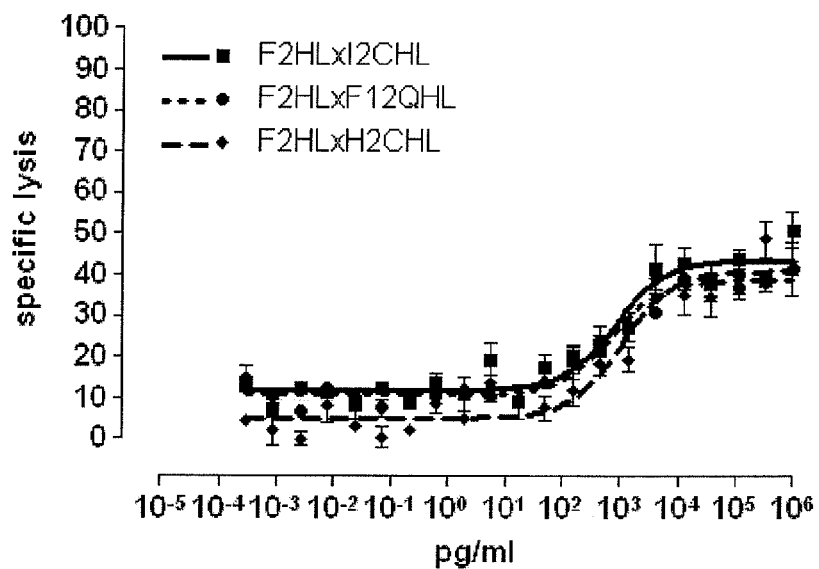
Figure 30H

Figure 32
SDS PAGE of the purification of V207C12 HL x H2C HL
Corresponding Western blot of the purification of V207C12 HL x H2C HL
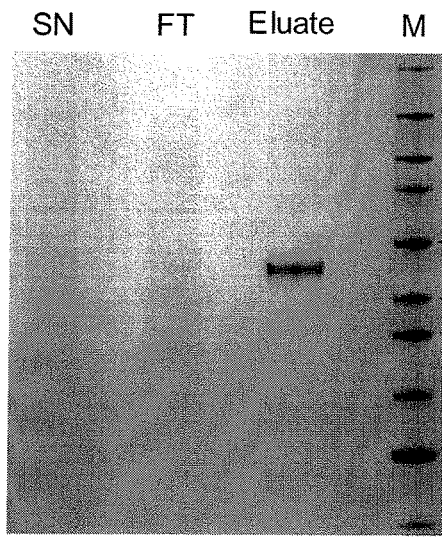
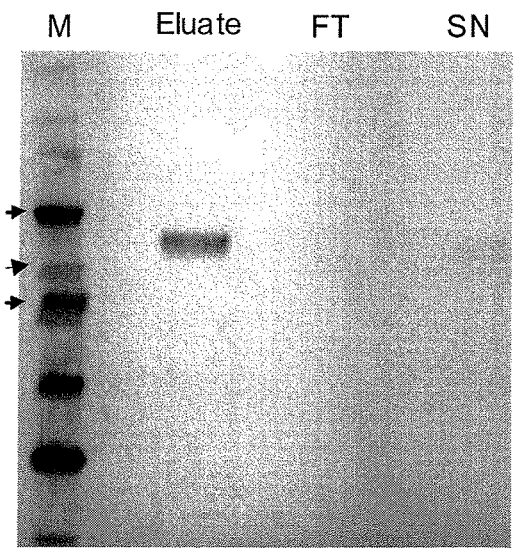
Figure 33
SDS PAGE of the purification of AF5HLxF12QHL
Corresponding Western blot of the purification of AF5HLxF12QHL
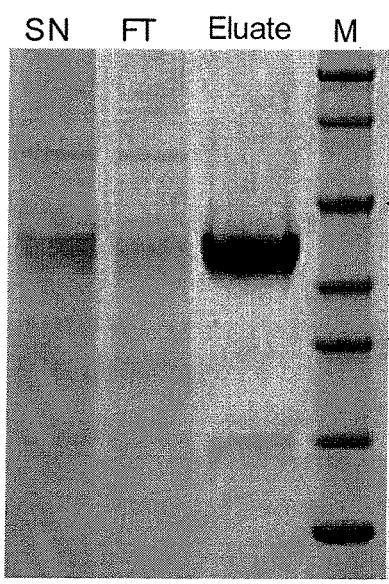
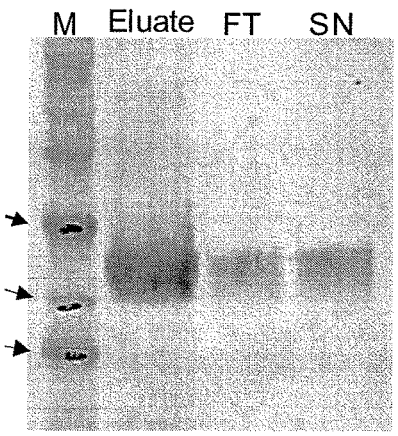

Figure 34
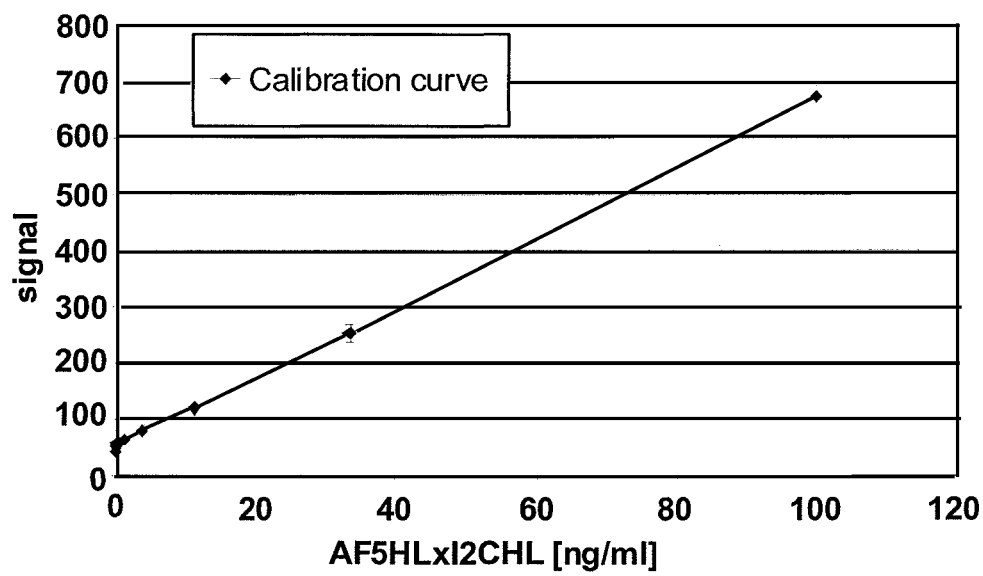
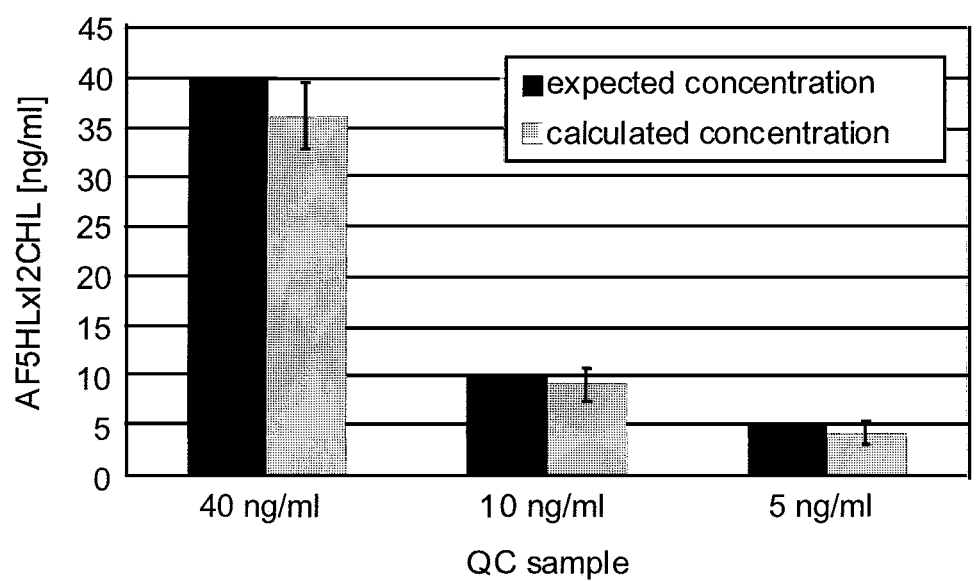

Figure 35
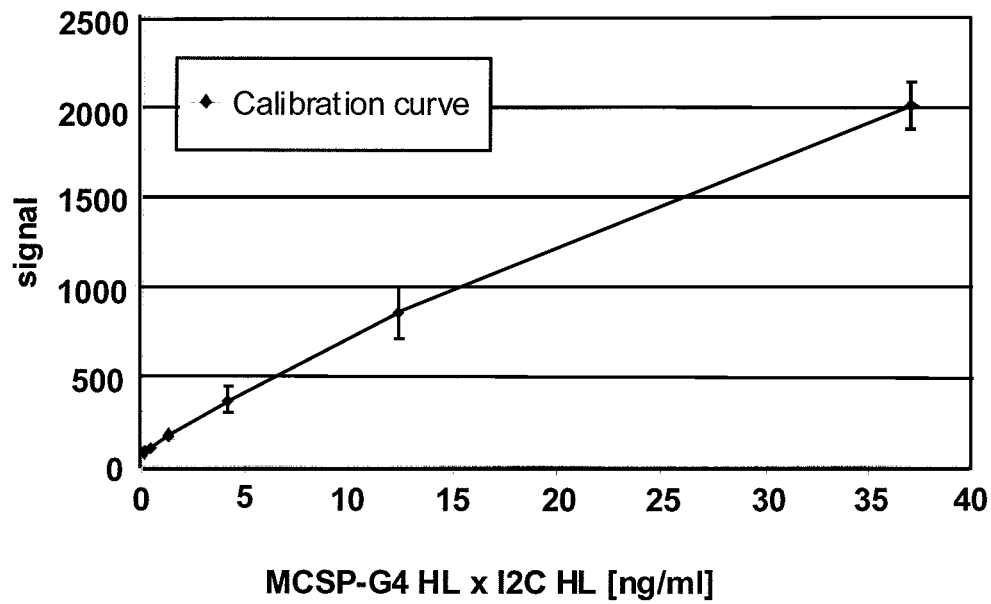
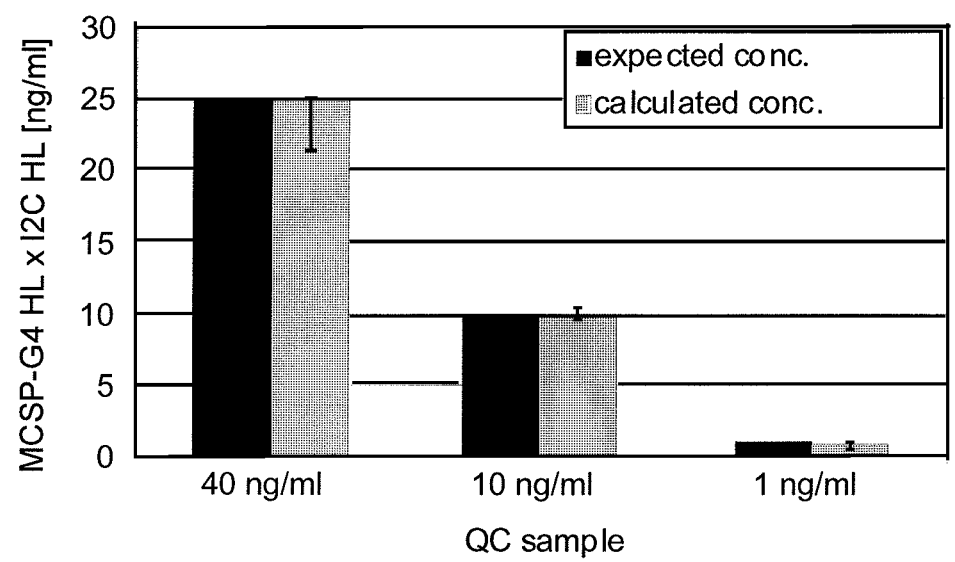

Figure 39A:
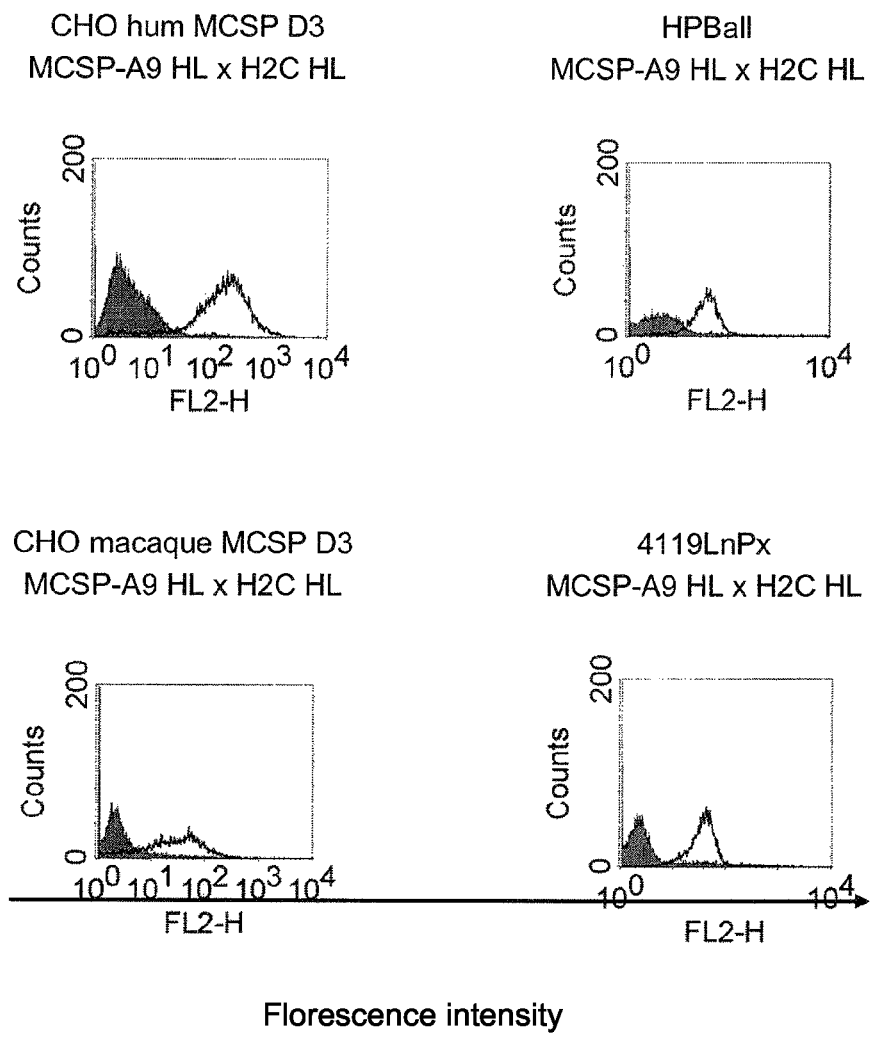
Figure 39:
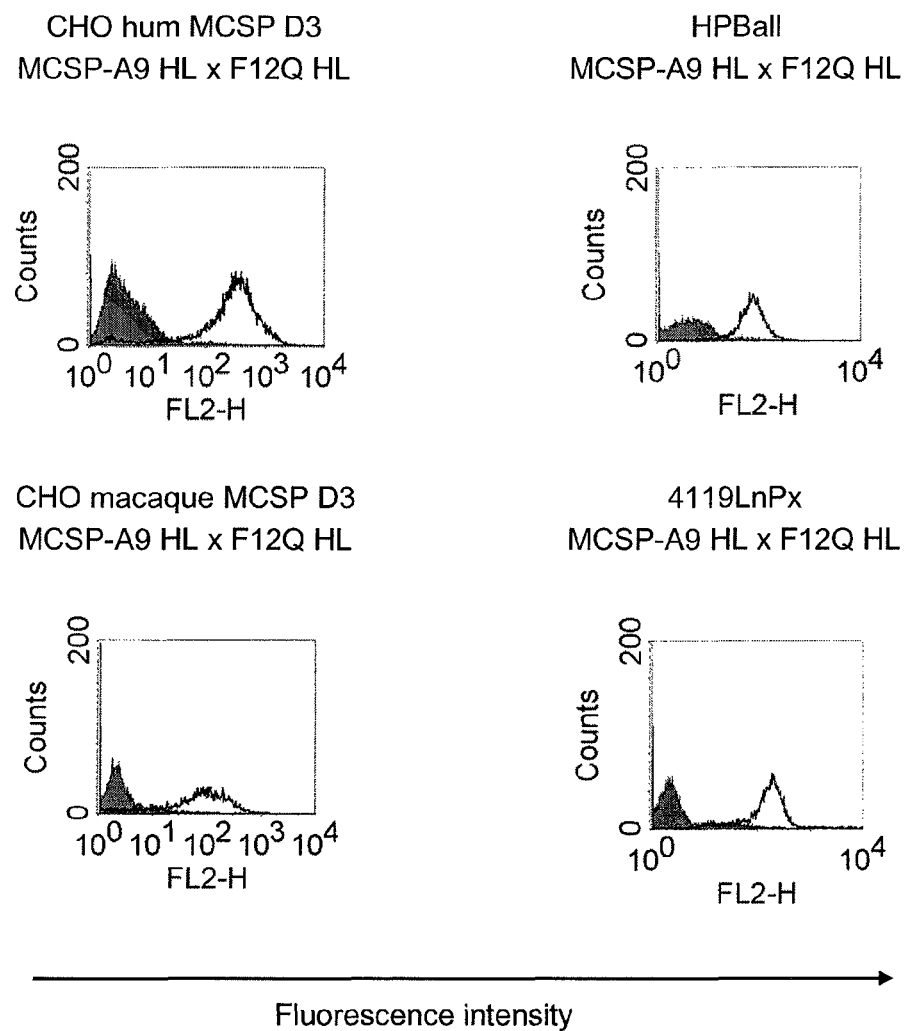
Figure 39D:
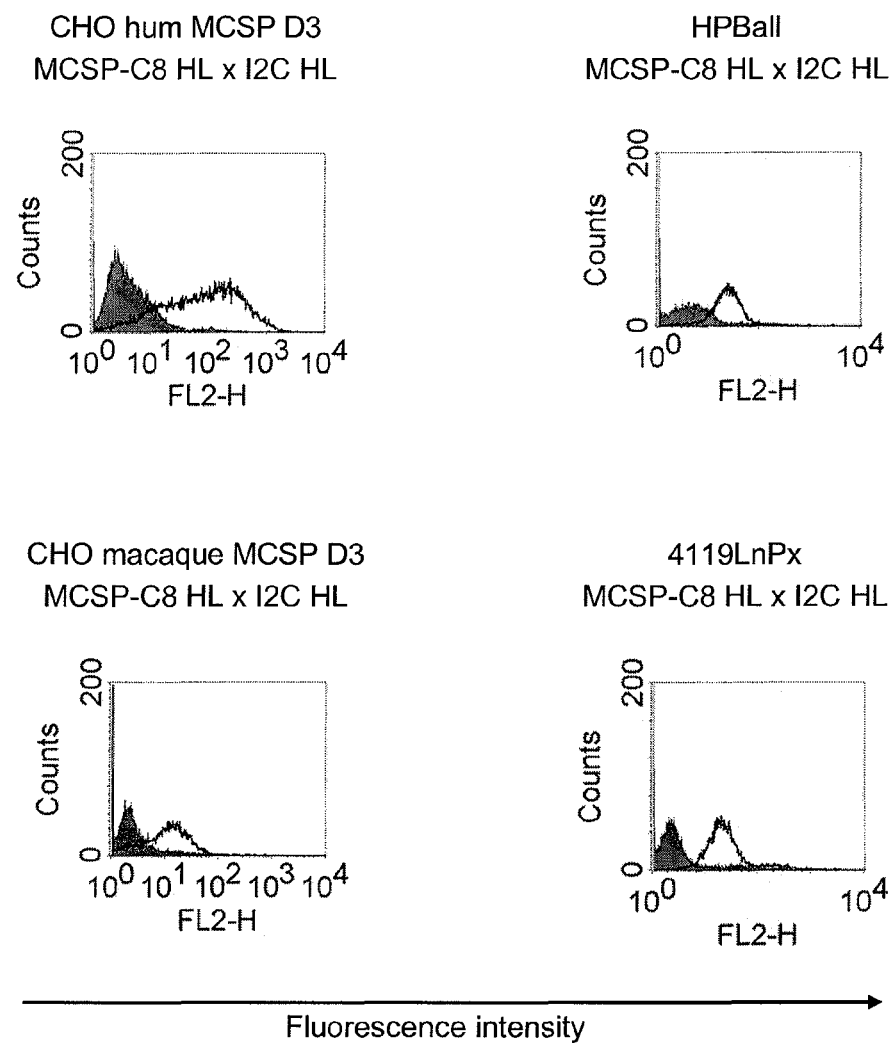
Figure 39E:
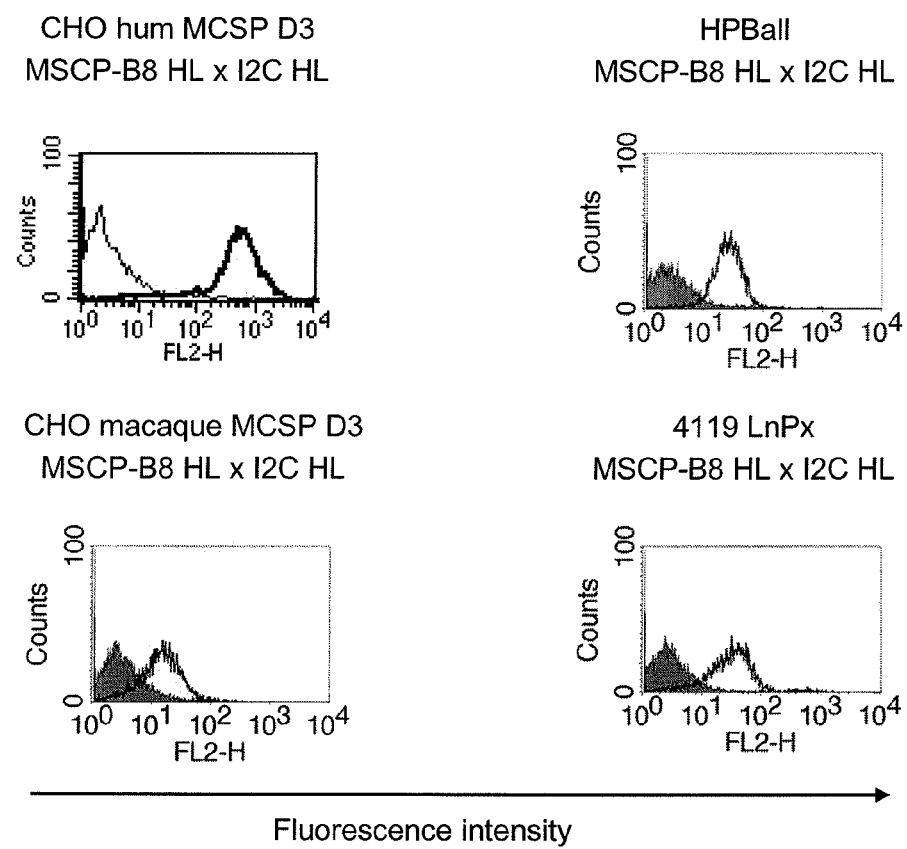
Figure 39F:
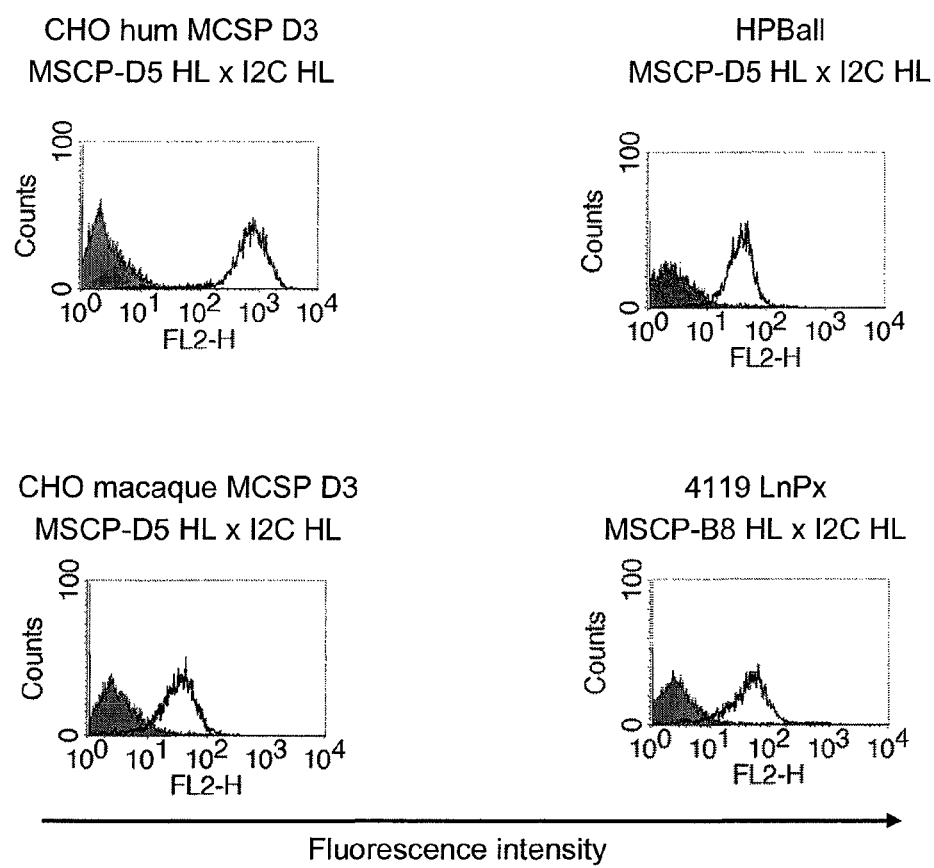
Figure 39G:
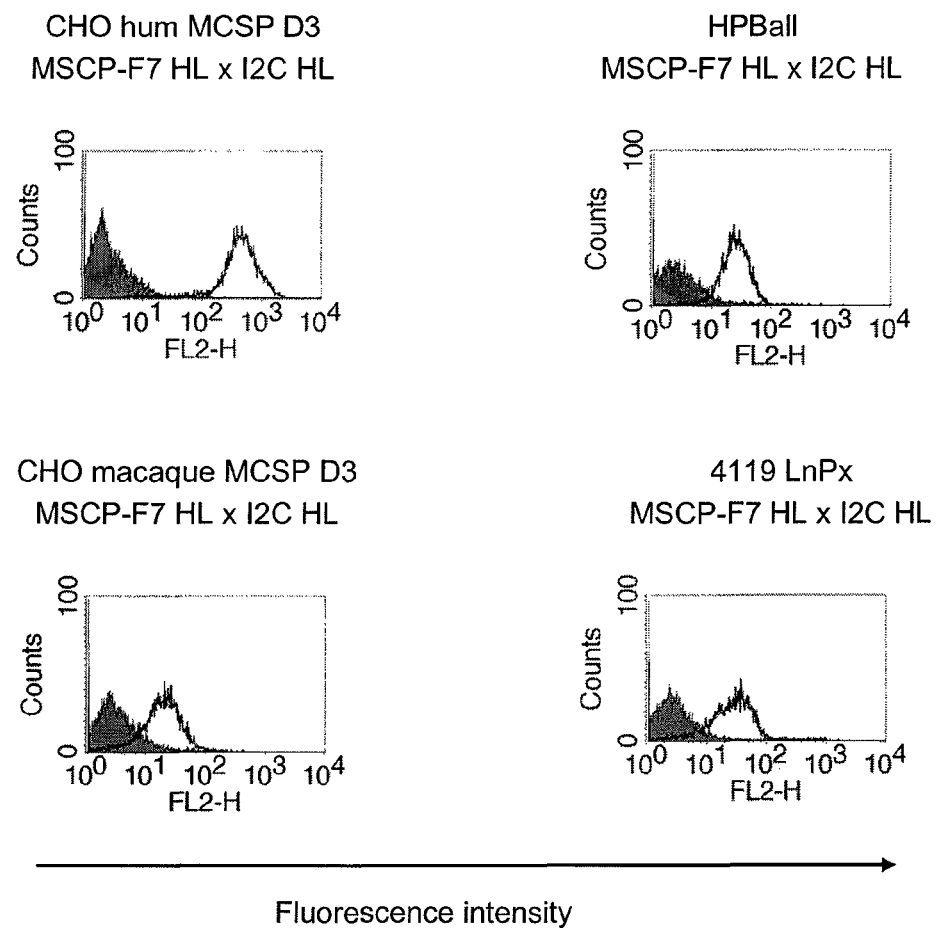
Figure 39H:
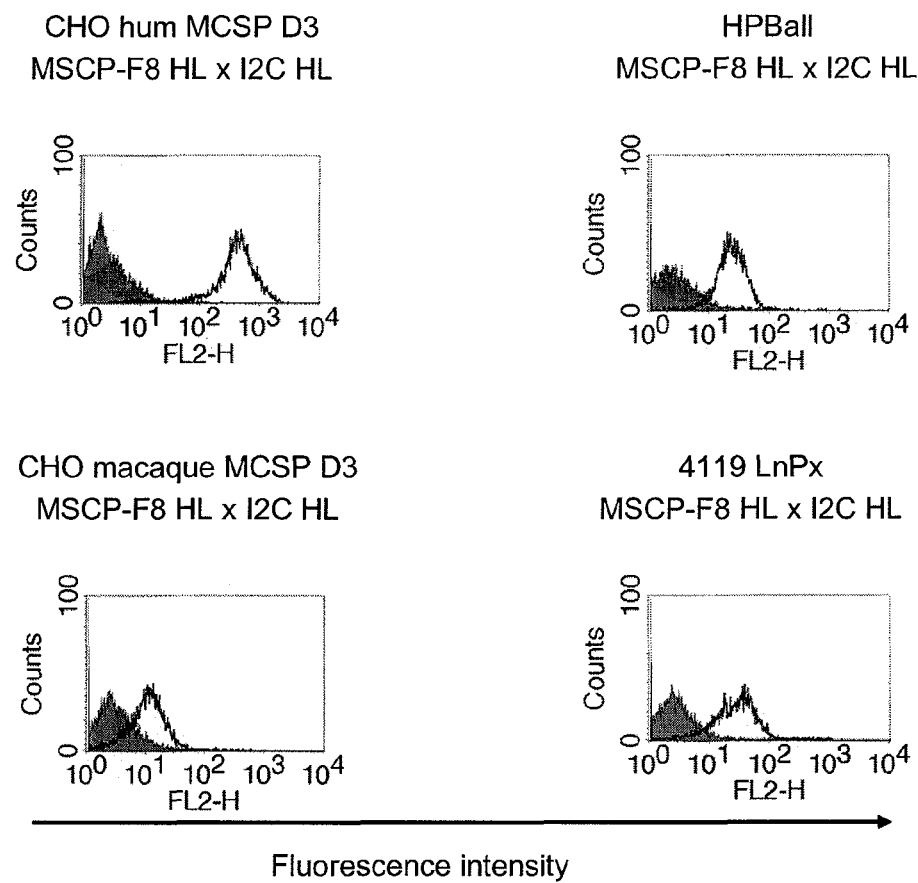
Figure 39I:
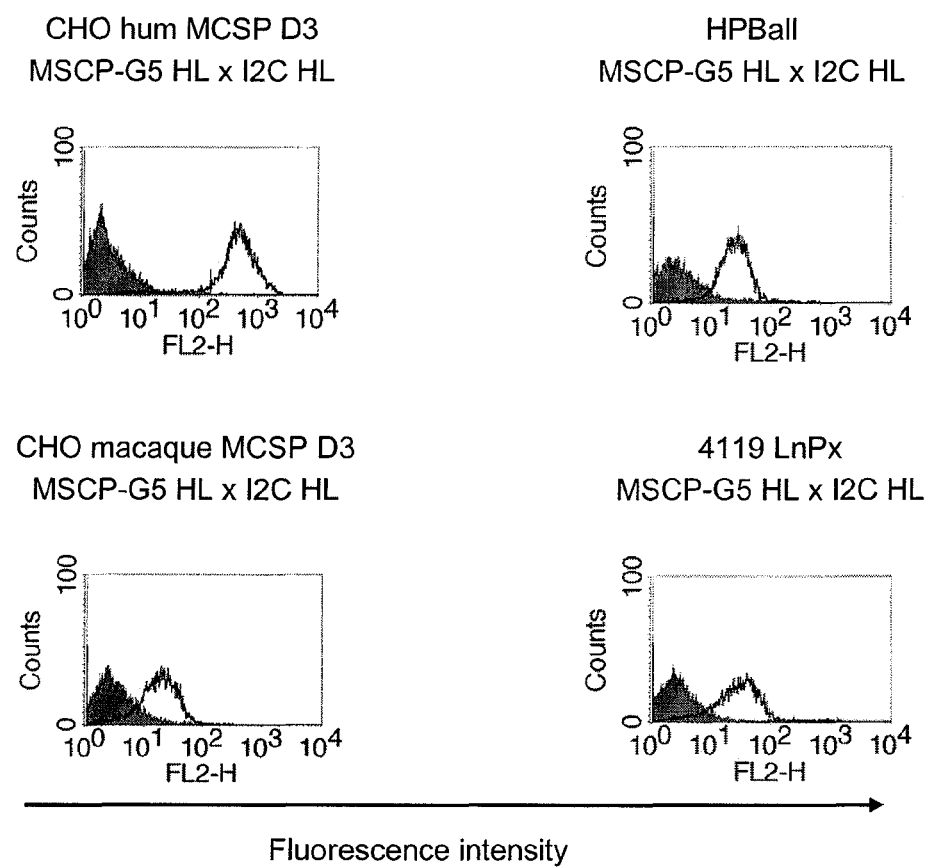
Figure 39J:
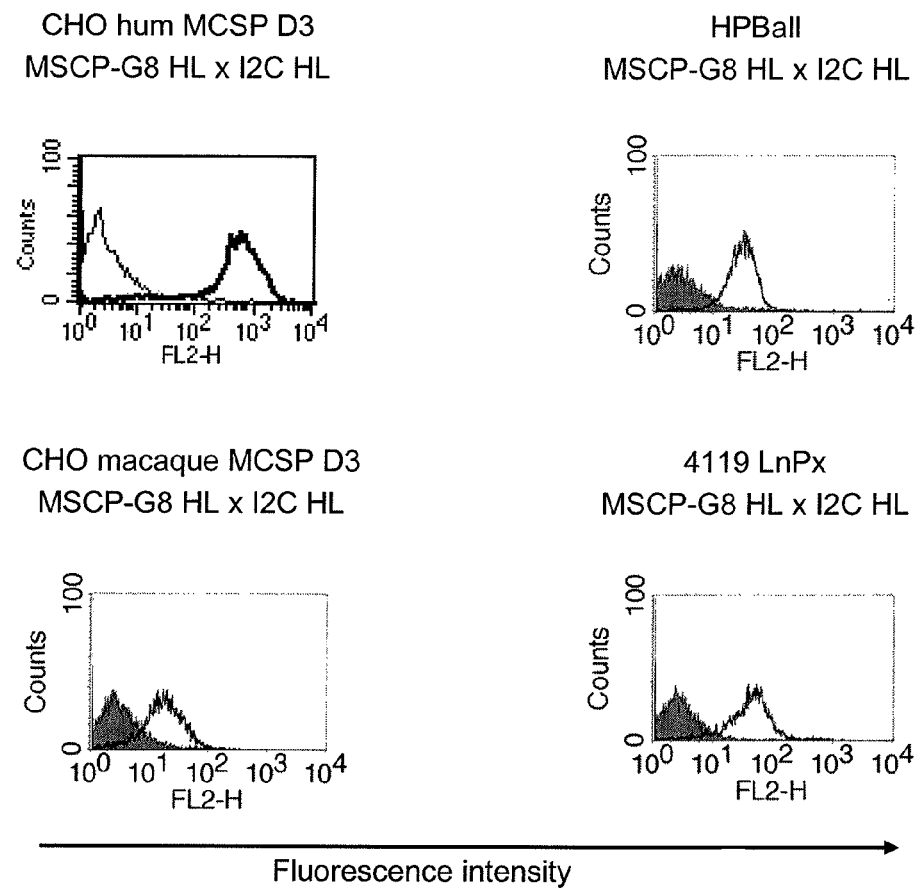
Figure 39L:
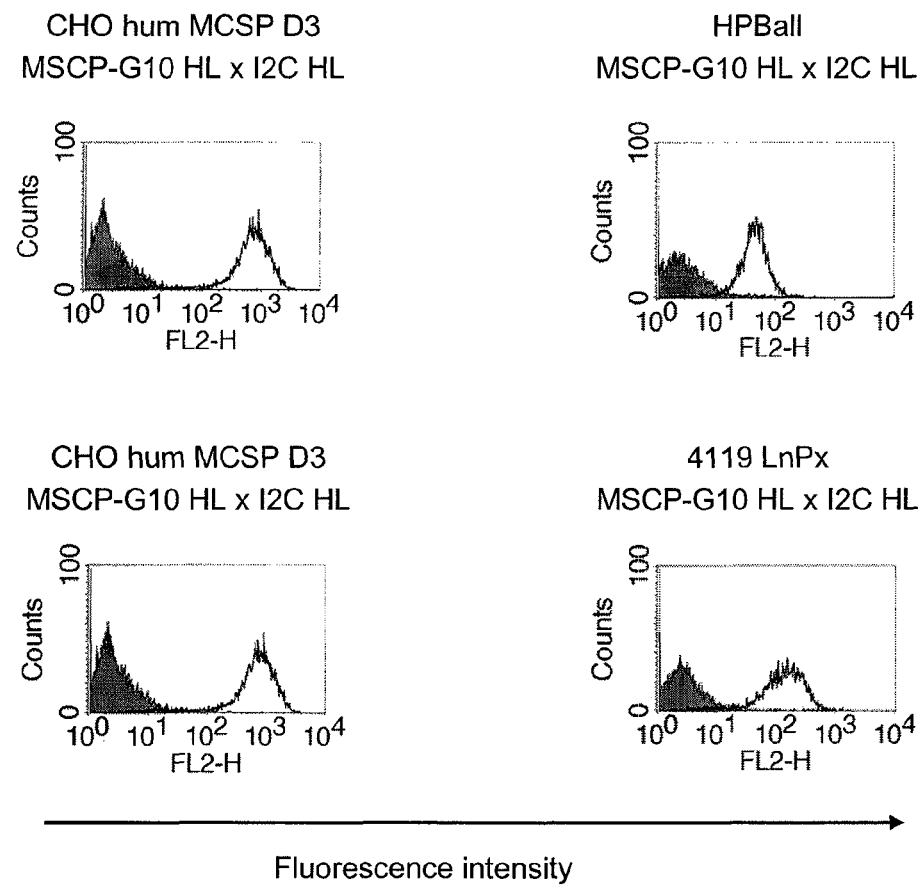

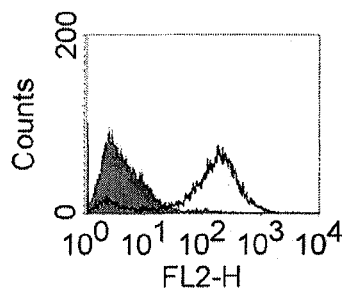
CHO hum MCSP D3
MCSP-A9 HL x I2C HL
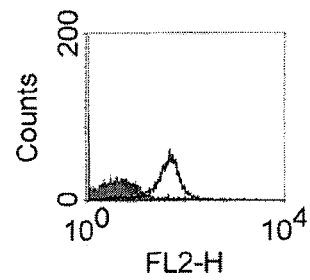
HPBall
MCSP-A9 HL x I2C HL
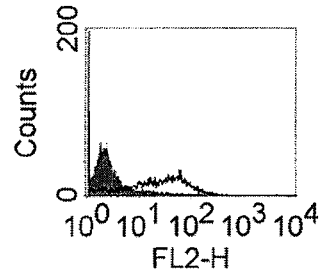
CHO macaque MCSP D3
MCSP-A9 HL x I2C HL
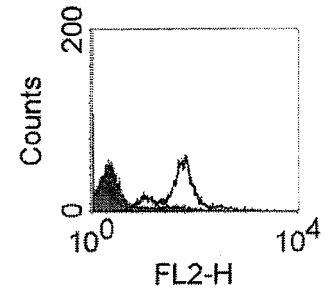
4119LnPx
MCSP-A9 HL x I2C HL
Fluorescence intensity
Figure 39C CHO hum MCSP D3
MSCP-B7 HL x I2C HL
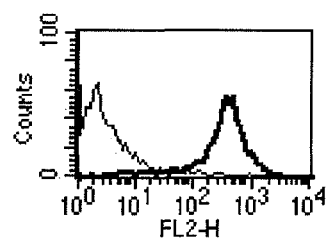
HPBall
MSCP-B7 HL x I2C HL
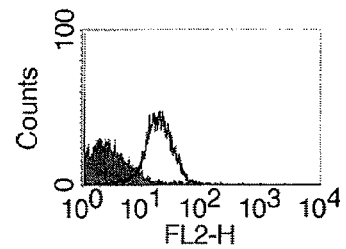
CHO macaque MCSP D3
MSCP-B7 HL x I2C HL
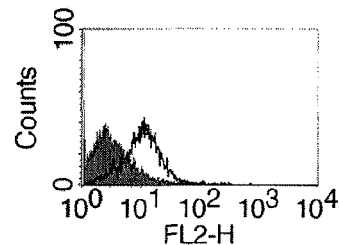
4119 LnPx
MSCP-B7 HL x I2C HL
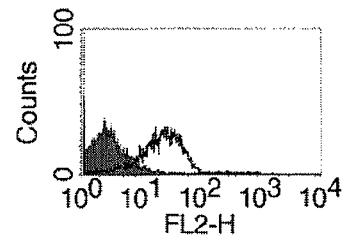
Fluorescence intensity
Figure 39K

Figure 40A
Effector cells: stimulated human CD4/CD56 depleted human PBMC
Target cells: CHO transfected with human MCSP D3
E:T ratio: 10:1
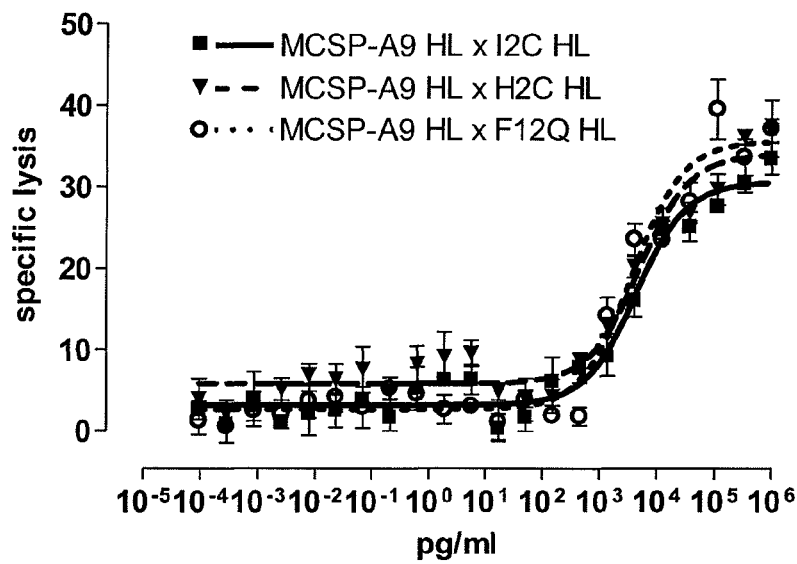
Effector cells: 4119 LnPx
Target cells: CHO transfected with macaque MCSP D3
E:T ratio: 10:1
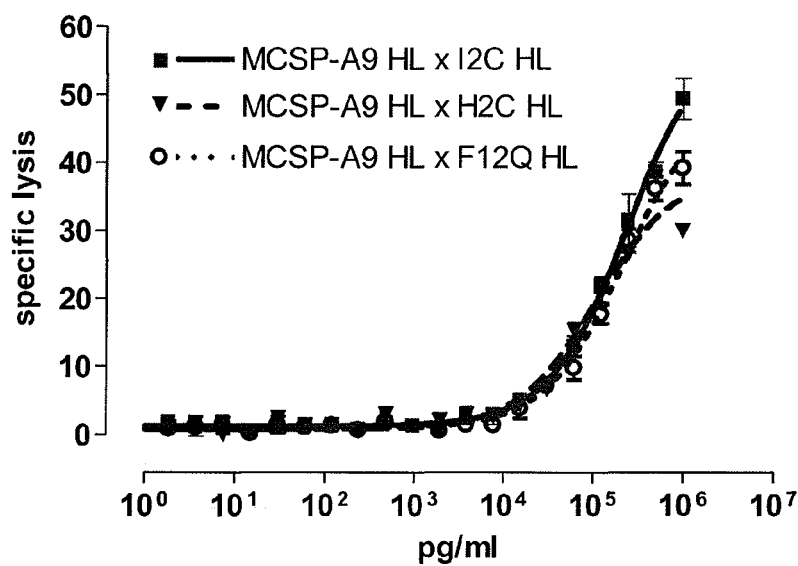

Figure 40B
Effector cells: stimulated human CD4/CD56 depleted human PBMC
Target cells: CHO transfected with human MCSP D3
E:T ratio: 10:1
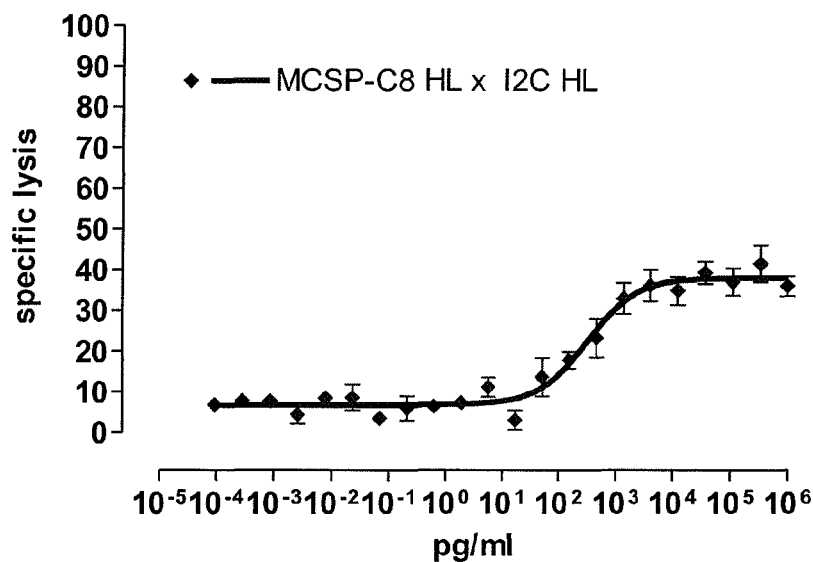
Effector cells: 4119 LnPx
Target cells: CHO transfected with macaque MCSP D3
E:T ratio: 10:1
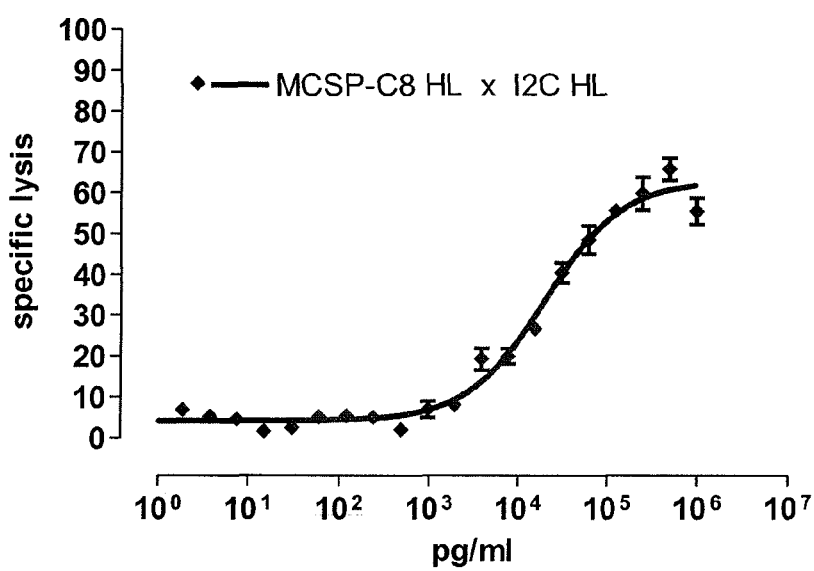

Figure 40C
Effector cells: stimulated human CD4/CD56 depleted human PBMC
Target cells: CHO transfected with human MCSP D3
E:T ratio: 10:1
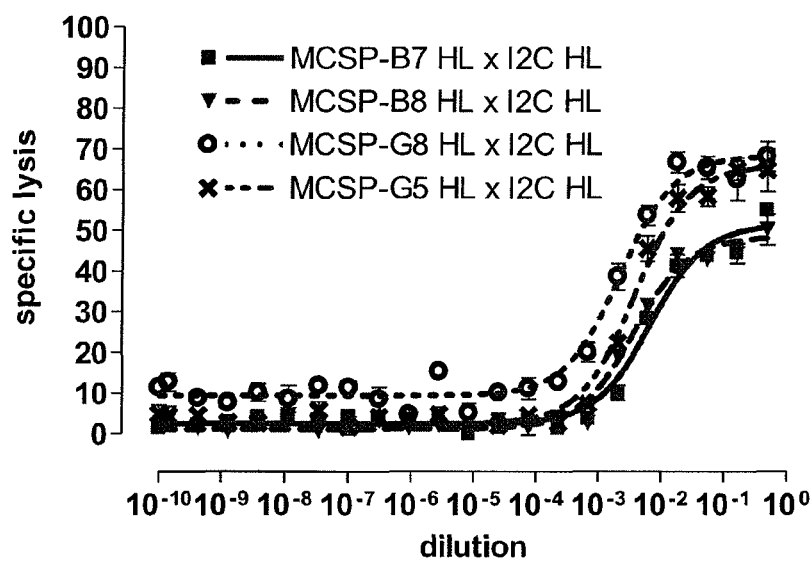
Effector cells: 4119 LnPx
Target cells: CHO transfected with macaque MCSP D3
E:T ratio: 10:1
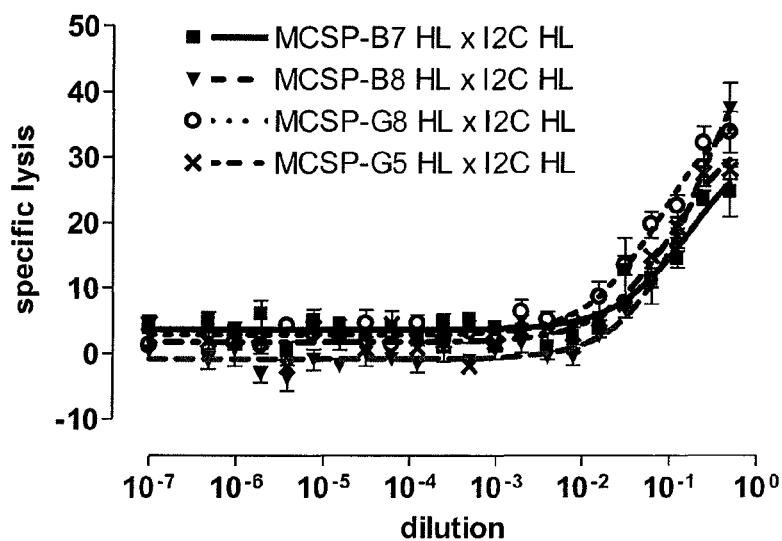

Figure 40D
Effector cells: stimulated human CD4/CD56 depleted human PBMC
Target cells: CHO transfected with human MCSP D3
E:T ratio: 10:1
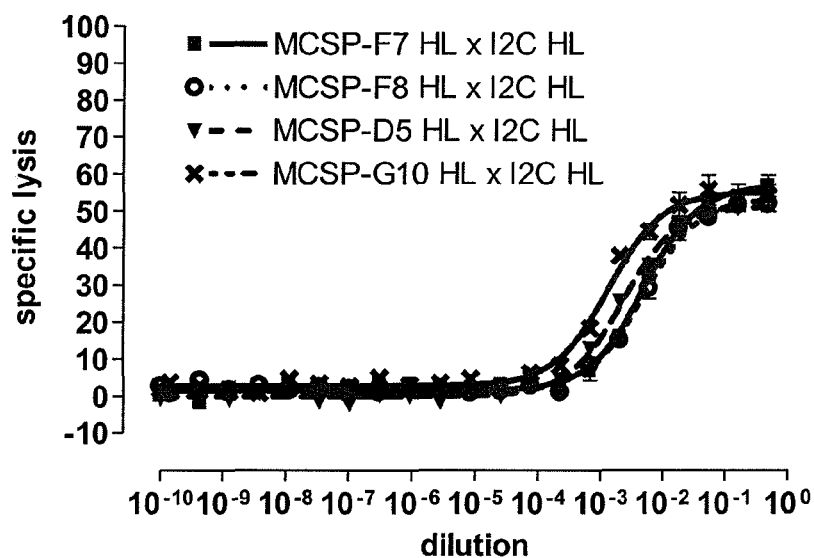
Effector cells: 4119 LnPx
Target cells: CHO transfected with macaque MCSP D3
E:T ratio: 10:1
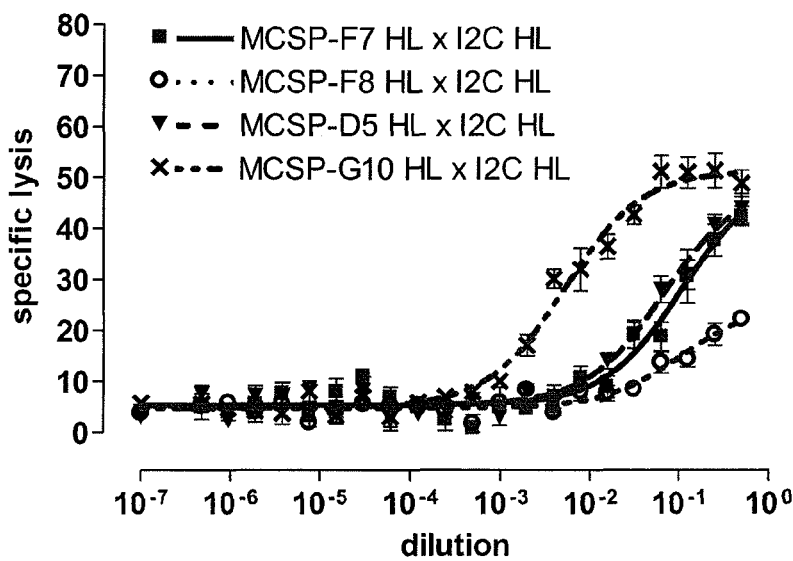

Figure 41A
Human CD33 transfected CHO
I2CHLxAF5HL
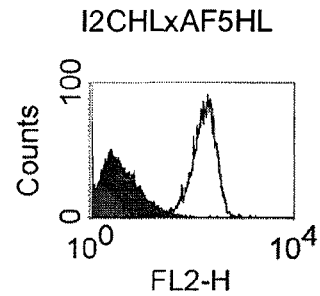
HPB-ALL
I2CHLxAF5HL
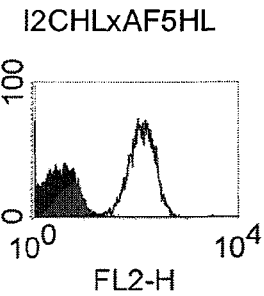
Macaque CD33 transfected CHO
I2CHLxAF5HL
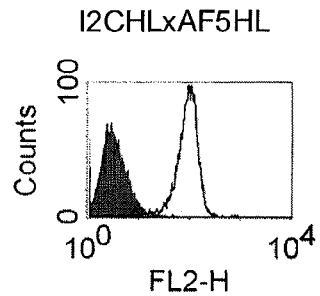
Macaque PBMC
I2CHLxAF5HL
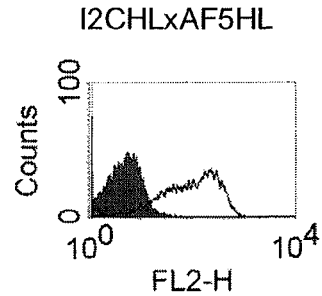
Human CD33 transfected CHO
H2CHLxAF5HL
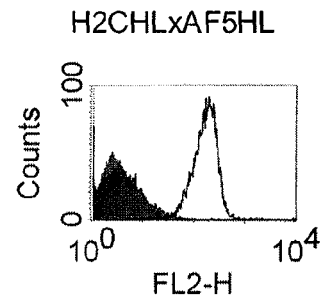
HPB-ALL
H2CHLxAF5HL
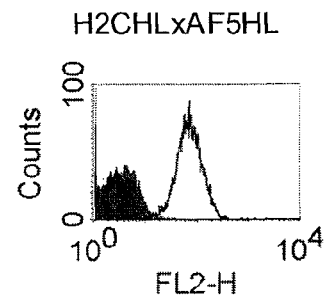
Macaque CD33 transfected CHO
H2CHLxAF5HL
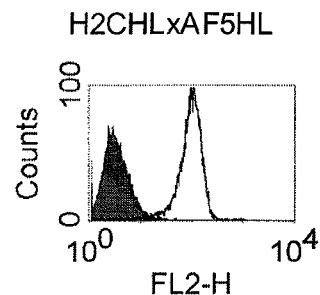
Macaque PBMC
H2CHLxAF5HL
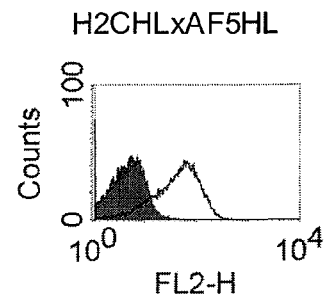

Figure 41B
Human CD33 transfected CHO
F12QHLxAF5HL
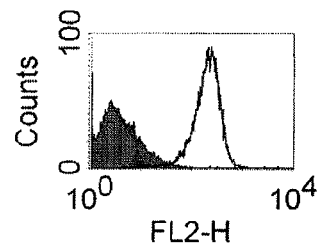
HPB-ALL
F12QHLxAF5HL
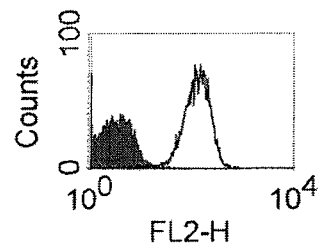
Macaque CD33 transfected CHO
F12QHLxAF5HL
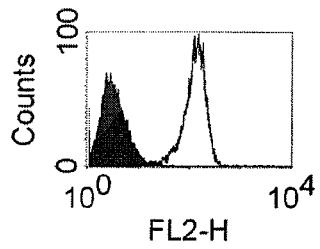
Macaque PBMC
F12QHLxAF5HL
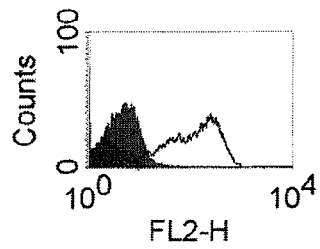

Figure 42
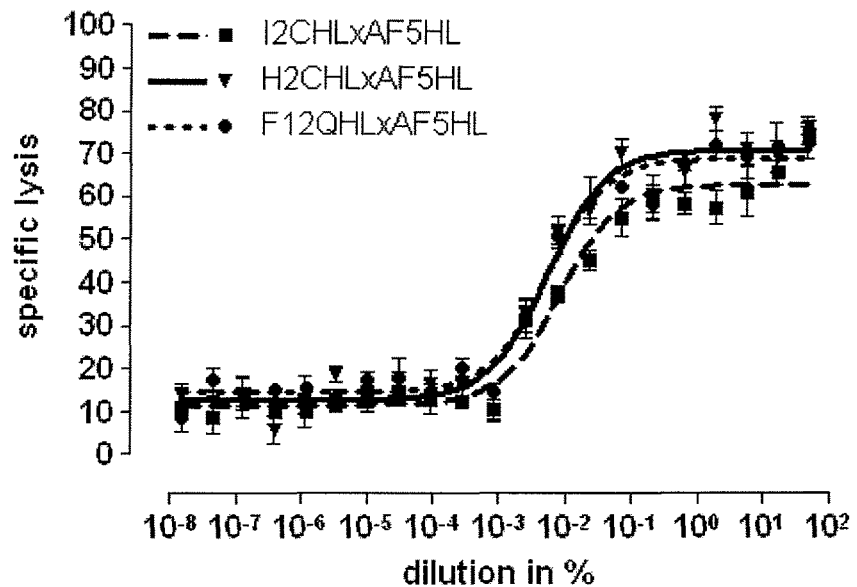
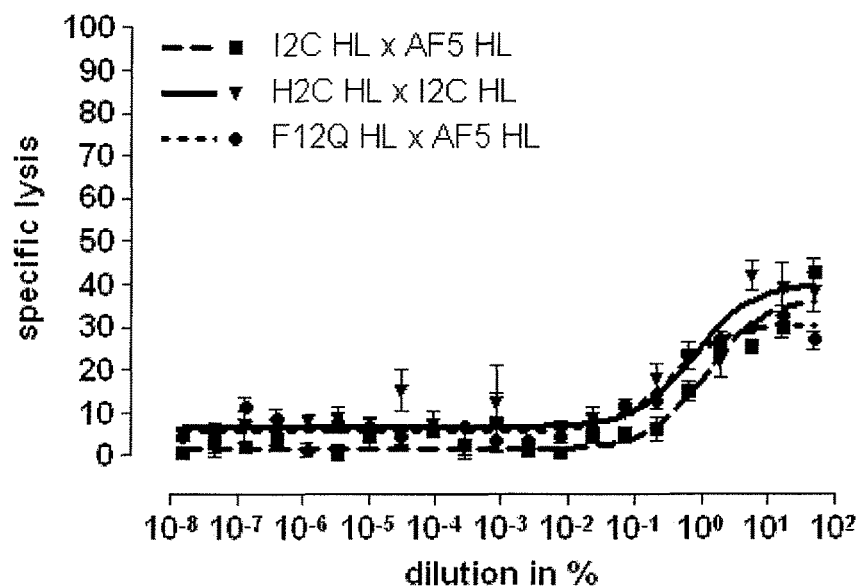

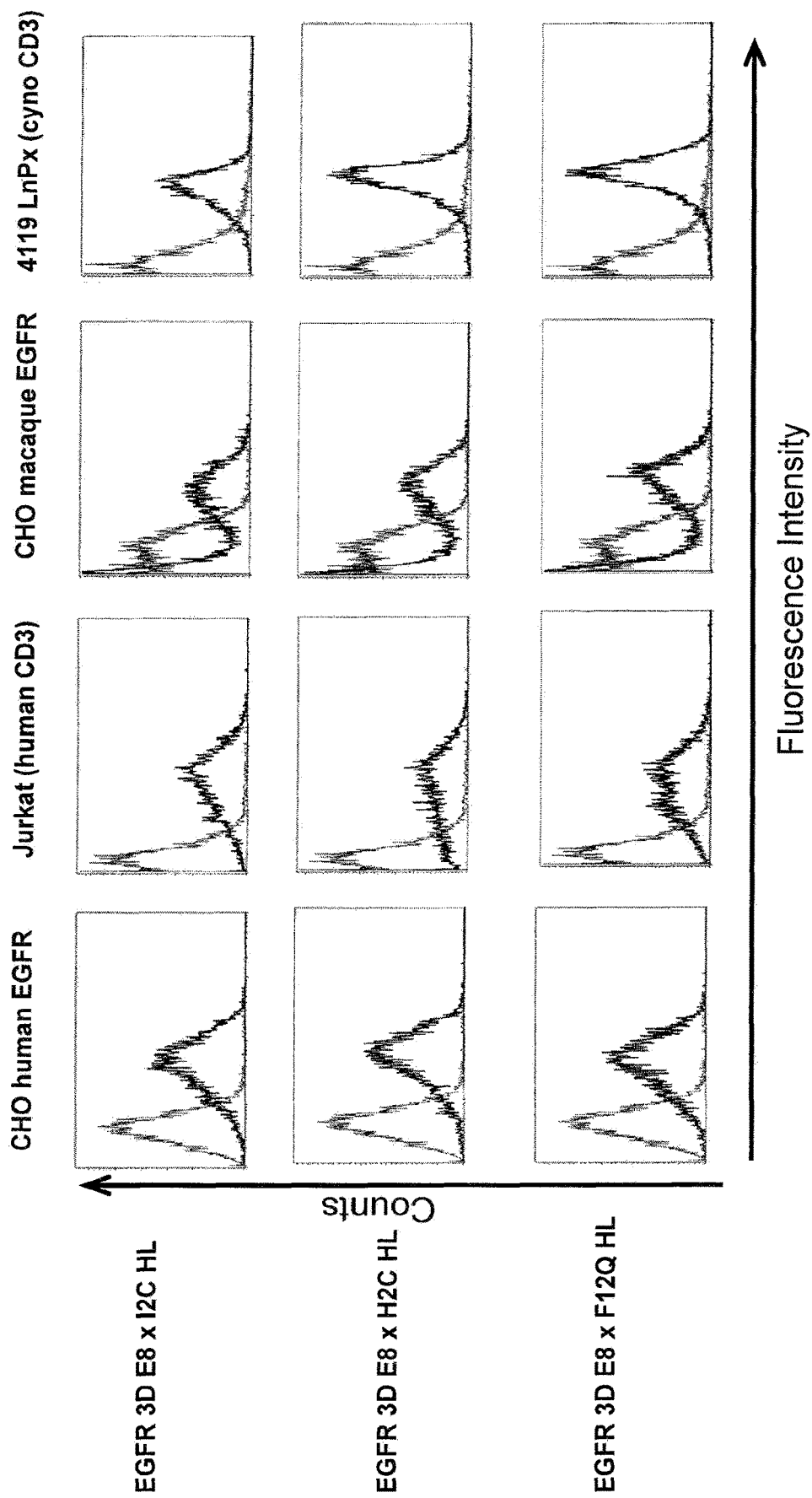
Figure 46/1

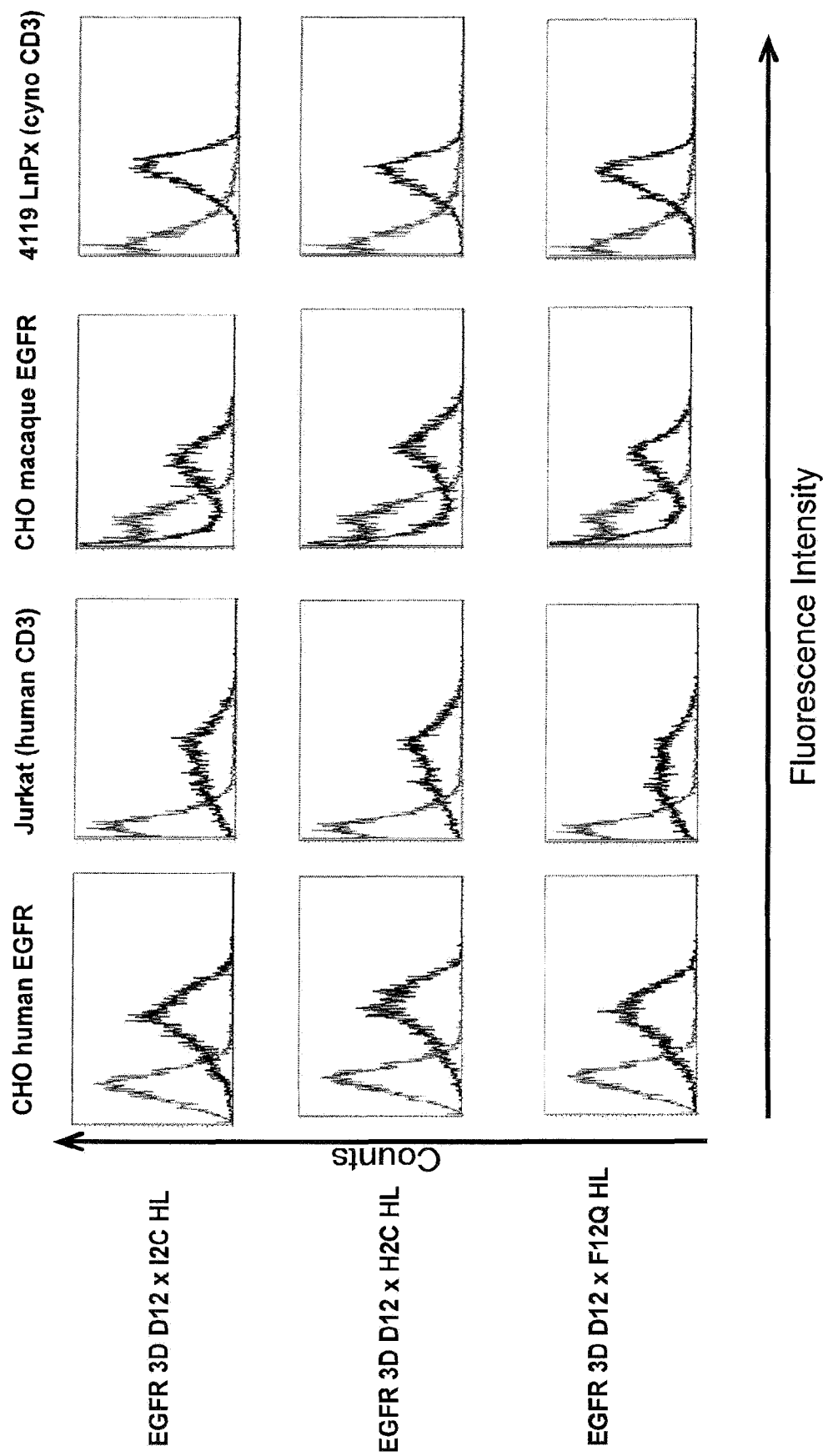
Figure 46/2

Figure 47/1
A) Effector cells: CD56 depleted unstimulated human PBMC
Target cells: CHO transfected with human EGFR
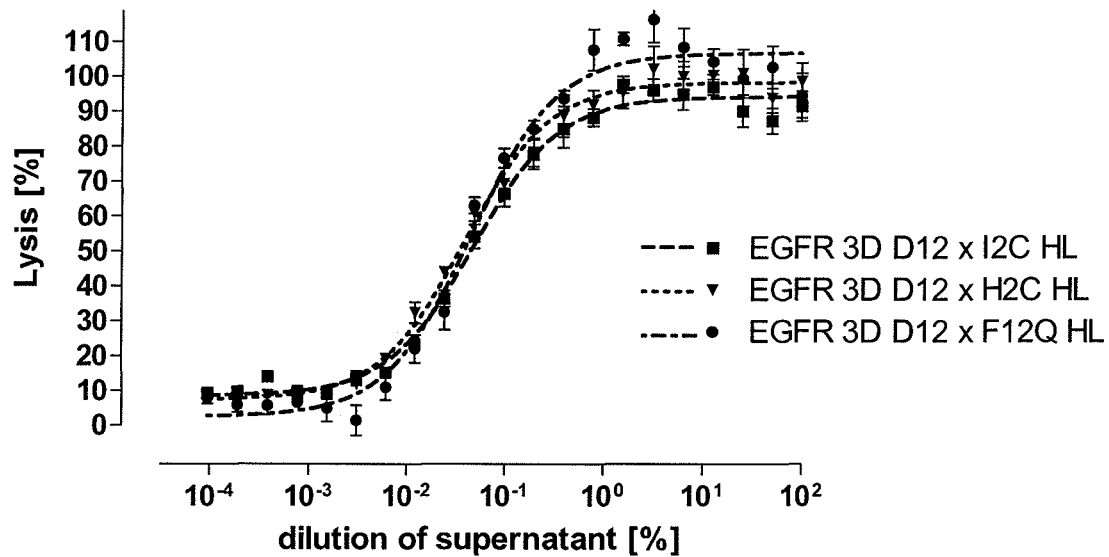
B) Effector cells: 4119LnPx
Target cells: CHO transfected with macaque EGFR
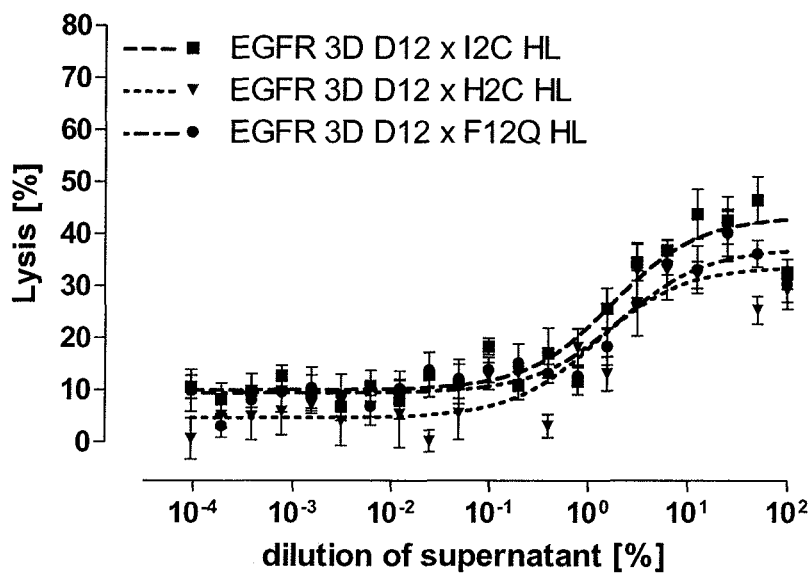

Figure 47/2
A) Effector cells: CD56 depleted unstimulated human PBMC
Target cells: CHO transfected with human EGFR
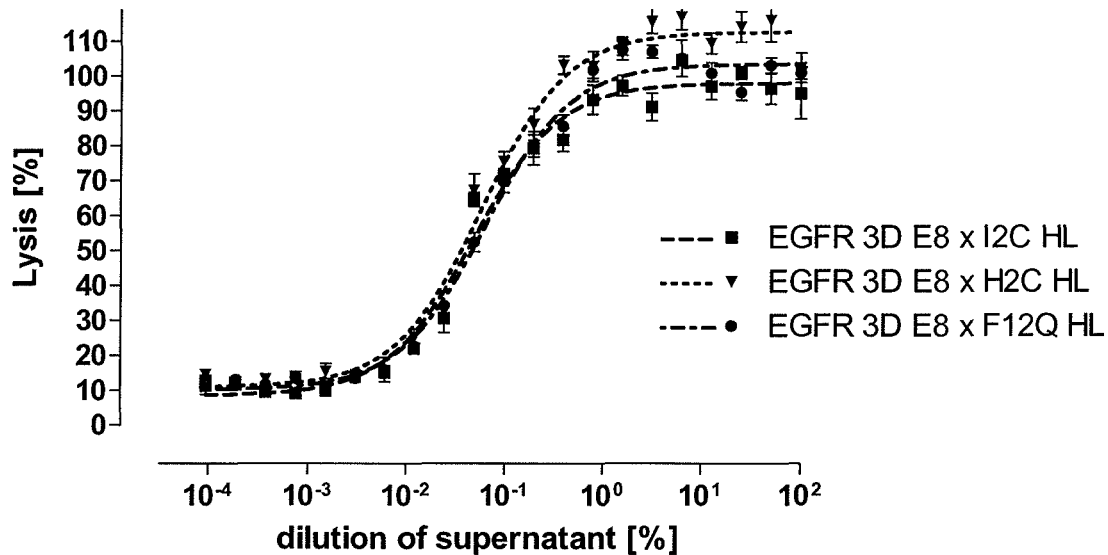
B) Effector cells: 4119LnPx
Target cells: CHO transfected with macaque EGFR
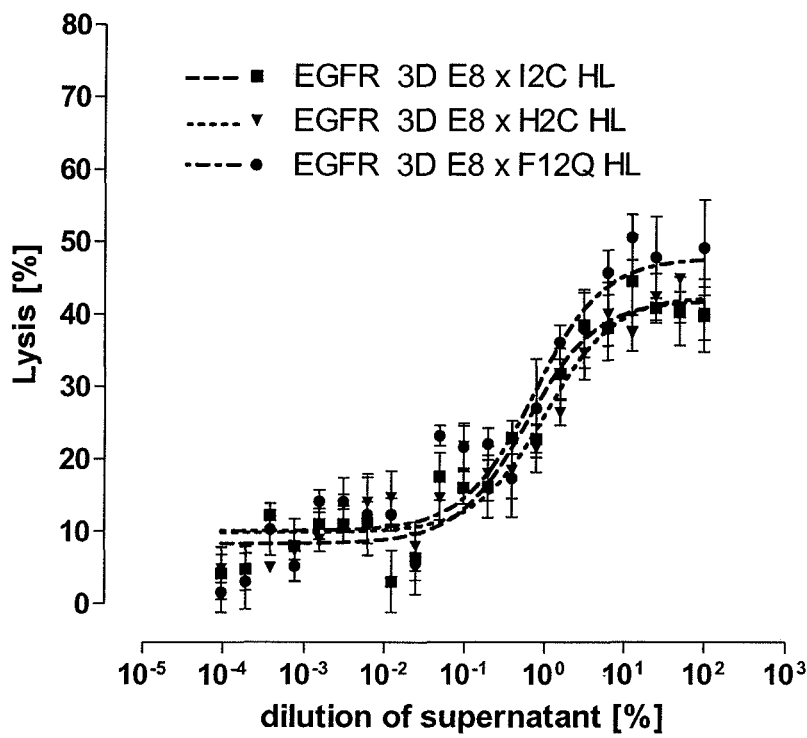

CROSS-SPECIES-SPECIFIC SINGLE DOMAIN BISPECIFIC SINGLE CHAIN ANTIBODY

This application includes a sequence listing submitted electronically by the file name 47400A_SeqListing.txt; Size: 659,781 bytes; Created: Nov. 7, 2023, and is incorporated herein by reference.

The present invention relates to a bispecific single chain antibody molecule comprising a first binding domain consisting of one antibody variable domain capable of binding to an epitope of the human and non-chimpanzee primate CD3 epsilon chain, wherein the epitope is part of an amino acid sequence comprised in the group consisting of SEQ ID NOs. 2, 4, 6, and 8, and a second binding domain capable of binding to an epitope of a human and a non-chimpanzee primate tumor target antigen. The invention further relates to a bispecific single chain antibody molecule comprising a first binding domain capable of binding to an epitope of human and non-chimpanzee primate CD3ε (epsilon) chain, wherein the epitope is part of an amino acid sequence comprised in the group consisting of SEQ ID NOs. 2, 4, 6, and 8, and a second binding domain consisting of one antibody variable domain capable of binding to an epitope of a human and a non-chimpanzee primate tumor target antigen. The invention also provides nucleic acids encoding said bispecific single chain antibody molecule as well as vectors and host cells and a process for its production. The invention further relates to pharmaceutical compositions comprising said bispecific single chain antibody molecule and medical uses of said bispecific single chain antibody molecule.

T cell recognition is mediated by clonotypically distributed alpha beta and gamma delta T cell receptors (TcR) that interact with the peptide-loaded molecules of the peptide MHC (pMHC) (Davis & Bjorkman, Nature 334 (1988), 395-402). The antigen-specific chains of the TcR do not possess signalling domains but instead are coupled to the conserved multisubunit signalling apparatus CD3 (Call, Cell 111 (2002), 967-979, Alarcon, Immunol. Rev. 191 (2003), 38-46, Malissen Immunol. Rev. 191 (2003), 7-27). The mechanism by which TcR ligation is directly communicated to the signalling apparatus remains a fundamental question in T cell biology (Alarcon, loc. cit.; Davis, Cell 110 (2002), 285-287). It seems clear that sustained T cell responses involve coreceptor engagement, TcR oligomerization, and a higher order arrangement of TcR-pMHC complexes in the immunological synapse (Davis & van der Merwe, Curr. Biol. 11 (2001), R289-R291, Davis, Nat. Immunol. 4 (2003), 217-224). However very early TcR signalling occurs in the absence of these events and may involve a ligand-induced conformational change in CD3 epsilon (Alarcon, loc. cit., Davis (2002), loc. cit., Gil, J. Biol. Chem. 276 (2001), 11174-11179, Gil, Cell 109 (2002), 901-912). The epsilon, gamma, delta and zeta subunits of the signalling complex associate with each other to form a CD3 epsilon-gamma heterodimer, a CD3 epsilon-delta □heterodimer, and a CD3 zeta-zeta homodimer (Call, loc. cit.). Various studies have revealed that the CD3 molecules are important for the proper cell surface expression of the alpha beta TcR and normal T cell development (Berkhout, J. Biol. Chem. 263 (1988), 8528-8536, Wang, J. Exp. Med. 188 (1998), 1375-1380, Kappes, Curr. Opin. Immunol. 7 (1995), 441-447). The solution structure of the ectodomain fragments of the mouse CD3 epsilon gamma heterodimer showed that the epsilon gamma subunits are both C2-set Ig domains that interact with each other to form an unusual side-to-side dimer configuration (Sun, Cell 105 (2001), 913-923). Although the cysteine-rich stalk appears to play an important role in driving CD3 dimerization (Su, loc. cit., Borroto, J. Biol. Chem. 273 (1998), 12807-12816), interaction by means of the extracellular domains of CD3 epsilon and CD3 gamma is sufficient for assembly of these proteins with TcR beta (Manolios, Eur. J. Immunol. 24 (1994), 84-92, Manolios & Li, Immunol. Cell Biol. 73 (1995), 532-536). Although still controversial, the dominant stoichiometry of the TcR most likely comprises one alpha beta TcR, one CD3 epsilon gamma heterodimer, one CD3 epsilon delta heterodimer and one CD3 zeta zeta homodimer (Call, loc. cit.). Given the central role of the human CD3 epsilon gamma heterodimer in the immune response, the crystal structure of this complex bound to the therapeutic antibody OKT3 has recently been elucidated (Kjer-Nielsen, PNAS 101, (2004), 7675-7680).

A number of therapeutic strategies modulate T cell immunity by targeting TcR signalling, particularly the anti-human CD3 monoclonal antibodies (mAbs) that are widely used clinically in immunosuppressive regimes. The CD3-specific mouse mAb OKT3 was the first mAb licensed for use in humans (Sgro, Toxicology 105 (1995), 23-29) and is widely used clinically as an immunosuppressive agent in transplantation (Chatenoud, Clin. Transplant 7 (1993), 422-430, Chatenoud, Nat. Rev. Immunol. 3 (2003), 123-132, Kumar, Transplant. Proc. 30 (1998), 1351-1352), type 1 diabetes (Chatenoud (2003), loc. cit.), and psoriasis (Utset, J. Rheumatol. 29 (2002), 1907-1913). Moreover, anti-CD3 mAbs can induce partial T cell signalling and clonal anergy (Smith, J. Exp. Med. 185 (1997), 1413-1422). OKT3 has been described in the literature as a potent T cell mitogen (Van Wauve, J. Immunol. 124 (1980), 2708-18) as well as a potent T cell killer (Wong, Transplantation 50 (1990), 683-9). OKT3 exhibits both of these activities in a time-dependent fashion; following early activation of T cells leading to cytokine release, upon further administration OKT3 later blocks all known T cell functions. It is due to this later blocking of T cell function that OKT3 has found such wide application as an immunosuppressant in therapy regimens for reduction or even abolition of allograft tissue rejection.

OKT3 reverses allograft tissue rejection most probably by blocking the function of all T cells, which play a major role in acute rejection. OKT3 reacts with and blocks the function of the CD3 complex in the membrane of human T cells, which is associated with the antigen recognition structure of T cells (TCR) and is essential for signal transduction. Which subunit of the TCR/CD3 is bound by OKT3 has been the subject of multiple studies. Though some evidence has pointed to a specificity of OKT3 for the epsilon-subunit of the TCR/CD3 complex (Tunnacliffe, Int. Immunol. 1 (1989), 546-50; Kjer-Nielsen, PNAS 101, (2004), 7675-7680). Further evidence has shown that OKT3 binding of the TCR/CD3 complex requires other subunits of this complex to be present (Salmeron, J. Immunol. 147 (1991), 3047-52).

Other well known antibodies specific for the CD3 molecule are listed in Tunnacliffe, Int. Immunol. 1 (1989), 546-50. As indicated above, such CD3 specific antibodies are able to induce various T cell responses such as lymphokine production (Von Wussow, J. Immunol. 127 (1981), 1197; Palacious, J. Immunol. 128 (1982), 337), proliferation (Van Wauve, J. Immunol. 124 (1980), 2708-18) and suppressor-T cell induction (Kunicka, in "Lymphocyte Typing II" 1 (1986), 223). That is, depending on the experimental conditions, CD3 specific monoclonal antibody can either inhibit or induce cytotoxicity (Leewenberg, J. Immunol. 134 (1985), 3770; Phillips, J. Immunol. 136 (1986) 1579; Platsoucas, Proc. Natl. Acad. Sci. USA 78 (1981), 4500; Itoh, Cell. Immunol. 108 (1987), 283-96; Mentzer, J. Immunol.

135 (1985), 34; Landegren, J. Exp. Med. 155 (1982), 1579; Choi (2001), Eur. J. Immunol. 31, 94-106; Xu (2000), Cell Immunol. 200, 16-26; Kimball (1995), Transpl. Immunol. 3, 212-221).

Although many of the CD3 antibodies described in the art have been reported to recognize the CD3 epsilon subunit of the CD3 complex, most of them bind in fact to conformational epitopes and, thus, only recognize CD3 epsilon in the native context of the TCR. Conformational epitopes are characterized by the presence of two or more discrete amino acid residues which are separated in the primary sequence, but come together on the surface of the molecule when the polypeptide folds into the native protein/antigen (Sela, (1969) Science 166, 1365 and Laver, (1990) Cell 61, 553-6). The conformational epitopes bound by CD3 epsilon antibodies described in the art may be separated in two groups. In the major group, said epitopes are being formed by two CD3 subunits, e.g. of the CD3 epsilon chain and the CD3 gamma or CD3 delta chain. For example, it has been found in several studies that the most widely used CD3 epsilon monoclonal antibodies OKT3, WT31, UCHT1, 7D6 and Leu-4 did not bind to cells singly transfected with the CD3-epsilon chain. However, these antibodies stained cells doubly transfected with a combination of CD3 epsilon plus either CD3 gamma or CD3 delta (Tunnacliffe, loc. cit.; Law, Int. Immunol. 14 (2002), 389-400; Salmeron, J. Immunol. 147 (1991), 3047-52; Coulie, Eur. J. Immunol. 21 (1991), 1703-9). In a second smaller group, the conformational epitope is being formed within the CD3 epsilon subunit itself. A member of this group is for instance mAb APA 1/1 which has been raised against denatured CD3 epsilon (Risueno, Blood 106 (2005), 601-8). Taken together, most of the CD3 epsilon antibodies described in the art recognize conformational epitopes located on two or more subunits of CD3. The discrete amino acid residues forming the three-dimensional structure of these epitopes may hereby be located either on the CD3 epsilon subunit itself or on the CD3 epsilon subunit and other CD3 subunits such as CD3 gamma or CD3 delta.

Another problem with respect to CD3 antibodies is that many CD3 antibodies have been found to be species-specific. Anti-CD3 monoclonal antibodies—as holds true generally for any other monoclonal antibodies—function by way of highly specific recognition of their target molecules. They recognize only a single site, or epitope, on their target CD3 molecule. For example, one of the most widely used and best characterized monoclonal antibodies specific for the CD3 complex is OKT-3. This antibody reacts with chimpanzee CD3 but not with the CD3 homolog of other primates, such as macaques, or with dog CD3 (Sandusky et al., J. Med. Primatol. 15 (1986), 441-451). Similarly, WO2005/118635 or WO2007/033230 describe human monoclonal CD3 epsilon antibodies which react with human CD3 epsilon but not with CD3 epsilon of mouse, rat, rabbit, or non-chimpanzee primates, such as rhesus monkey, cynomolgus monkey or baboon monkey. The anti-CD3 monoclonal antibody UCHT-1 is also reactive with CD3 from chimpanzee but not with CD3 from macaques (own data). On the other hand, there are also examples of monoclonal antibodies, which recognize macaque antigens, but not their human counterparts. One example of this group is monoclonal antibody FN-18 directed to CD3 from macaques (Uda et al., J. Med. Primatol. 30 (2001), 141-147). Interestingly, it has been found that peripheral lymphocytes from about 12% of cynomolgus monkeys lacked reactivity with anti-rhesus monkey CD3 monoclonal antibody (FN-18) due to a polymorphism of the CD3 antigen in macaques. Uda et al. described a substitution of two amino acids in the CD3 sequence of cynomolgus monkeys, which are not reactive with FN-18 antibodies, as compared to CD3 derived from animals, which are reactive with FN-18 antibodies (Uda et al., J Med Primatol. 32 (2003), 105-10; Uda et al., J Med Primatol. 33 (2004), 34-7).

The discriminatory ability, i.e. the species specificity, inherent not only to CD3 monoclonal antibodies (and fragments thereof), but to monoclonal antibodies in general, is a significant impediment to their development as therapeutic agents for the treatment of human diseases. In order to obtain market approval any new candidate medication must pass through rigorous testing. This testing can be subdivided into preclinical and clinical phases: Whereas the latter—further subdivided into the generally known clinical phases I, II and III—is performed in human patients, the former is performed in animals. The aim of pre-clinical testing is to prove that the drug candidate has the desired activity and most importantly is safe.

Only when the safety in animals and possible effectiveness of the drug candidate has been established in preclinical testing this drug candidate will be approved for clinical testing in humans by the respective regulatory authority. Drug candidates can be tested for safety in animals in the following three ways, (i) in a relevant species, i.e. a species where the drug candidates can recognize the ortholog antigens, (ii) in a transgenic animal containing the human antigens and (iii) by use of a surrogate for the drug candidate that can bind the ortholog antigens present in the animal. Limitations of transgenic animals are that this technology is typically limited to rodents. Between rodents and man there are significant differences in the physiology and the safety results cannot be easily extrapolated to humans. The limitations of a surrogate for the drug candidate are the different composition of matter compared to the actual drug candidate and often the animals used are rodents with the limitation as discussed above. Therefore, preclinical data generated in rodents are of limited predictive power with respect to the drug candidate. The approach of choice for safety testing is the use of a relevant species, preferably a lower primate. The limitation now of monoclonal antibodies suitable for therapeutic intervention in man described in the art is that the relevant species are higher primates, in particular chimpanzees. Chimpanzees are considered as endangered species and due to their human-like nature, the use of such animals for drug safety testing has been banned in Europe and is highly restricted elsewhere. CD3 has also been successfully used as a target for bispecific single chain antibodies in order to redirect cytotoxic T cells to pathological cells, resulting in the depletion of the diseased cells from the respective organism (WO 99/54440; WO 04/106380). For example, Bargou et al. (Science 321 (2008): 974-7) have recently reported on the clinical activity of a CD19×CD3 bispecific antibody construct called blinatumomab, which has the potential to engage all cytotoxic T cells in human patients for lysis of cancer cells. Doses as low as 0.005 milligrams per square meter per day in non-Hodgkin's lymphoma patients led to an elimination of target cells in blood. Partial and complete tumor regressions were first observed at a dose level of 0.015 milligrams, and all seven patients treated at a dose level of 0.06 milligrams experienced a tumor regression. Blinatumomab also led to clearance of tumor cells from bone marrow and liver. Though this study established clinical proof of concept for the therapeutic potency of the bispecific single chain antibody format in treating blood-cell derived cancer, there is still need for successful concepts for therapies of other cancer types.

In the event that a bispecific antibody is intended for therapeutic use, it is desirable to produce high amounts of this antibody solubly and in the desired functional form. The production of functionally active antibody becomes especially critical when producing bispecific antibodies of which one portion is able to activate and recruit the cytotoxic potential of human immune effector cells. For example, a produced antibody devoid of functional activity will not lead to the desired activation of human immune effector cells, while a bispecific antibody which is functionally active, albeit not in the desired manner, as for example may be the case when the bispecific antibody is produced in a heterogeneous form containing multiple isomers, may activate and recruit the cytotoxic potential of human immune effector cells in unforeseeable and/or unintended manners.

One example of the sort of unintended activation mentioned above is the possibility of activation of human immune effector cells to exert an effect on other human immune effector cells instead of on a target cell intended for destruction. This type of immune effector cell fratricide may jeopardize the effectiveness of a regimen of therapy depending on the activity of human immune effector cells.

However, reliable production of large amounts of functional single chain antibody, especially large amounts of functional bispecific single chain antibody, from prokaryotic expression systems such as E. coli is often limited, necessitating costly optimization (Baneyx 1999. Curr Op in Biotechnol 10, 411-21).

In summary, bispecific antibody constructs can be of great therapeutic use in redirecting the powerful potential of the body's own immune system to achieve the destruction of diseased cells. By the same token, however, the activation of such a powerful means of eradicating or neutralizing unwanted cells requires that this power be controlled as precisely as possible so that the cytotoxic potential of the immune system is recruited and applied only in the direction intended and no other.

Clearly, when one specific binding arm of a bispecific single chain antibody is to recruit the activity of a human immune effector cell, for example a cytotoxic T cell, there exists an especially heightened and, as yet, unmet need for bispecific single chain antibodies which overcome limitations as described above.

The present invention provides a bispecific single chain antibody molecule comprising a first binding domain consisting of one antibody variable domain capable of binding to an epitope of the human and non-chimpanzee primate CD3ε (epsilon) chain, wherein the epitope is part of an amino acid sequence comprised in the group consisting of SEQ ID NOs. 2, 4, 6, and 8, and a second binding domain capable of binding to an epitope of a human and a non-chimpanzee primate tumor target antigen.

Furthermore, the present invention relates to a bispecific single chain antibody molecule comprising a first binding domain capable of binding to an epitope of human and non-chimpanzee primate CD3ε (epsilon) chain, wherein the epitope is part of an amino acid sequence comprised in the group consisting of SEQ ID NOs. 2, 4, 6, and 8, and a second binding domain consisting of one antibody variable domain capable of binding to an epitope of a human and a non-chimpanzee primate tumor target antigen.

According to another embodiment of the invention, the first binding domain of the bispecific antibody comprises one antibody variable domain, preferably a VHH domain.

According to one embodiment of the invention, the first binding domain of the bispecific antibody comprises two antibody variable domains, preferably a scFv, i.e. VH-VL or VL-VH.

According to another embodiment of the invention, the second binding domain of the bispecific antibody comprises one antibody variable domain, preferably a VHH domain.

According to one embodiment of the invention, the second binding domain of the bispecific antibody comprises two antibody variable domains, preferably a scFv, i.e. VH-VL or VL-VH.

In its minimal form, the total number of antibody variable regions in the bispecific antibody according to the invention is thus only two. For example, such an antibody could comprise two VH or two VHH domains. Here, not two variable domains VH and VL (a scFv) but rather only one variable domain is necessary to specifically bind to each antigen of interest. The bispecific antibody of the invention is thus approximately half the size of conventional bispecific single chain antibodies containing four antibody variable domains.

The greater simplicity in molecular design of the bispecific antibody of the invention correlates to greater possible simplicity in the host expression system used for its production in functionally active form. As such, the small size of the inventive bispecific antibody opens up avenues of production hitherto closed to conventional bispecific single chain antibodies with four antibody variable domains. For example, the bispecific antibody of the invention may be easily produced in conventional, well understood and cheap bacterial expression systems such as E. coli in amounts which are desired for therapeutic applications. Moreover, the bispecific antibody of the invention is more stable than conventional antibodies.

Though T cell-engaging bispecific single chain antibodies described in the art have great therapeutic potential for the treatment of malignant diseases, most of these bispecific molecules are limited in that they are species specific and recognize only human antigen, and—due to genetic similarity—likely the chimpanzee counterpart. The advantage of the present invention is the provision of a bispecific single chain antibody comprising a binding domain exhibiting cross-species specificity to human and non-chimpanzee primate of the CD3 epsilon chain.

In the present invention, an N-terminal 1-27 amino acid residue polypeptide fragment of the extracellular domain of CD3 epsilon was surprisingly identified which—in contrast to all other known epitopes of CD3 epsilon described in the art—maintains its three-dimensional structural integrity when taken out of its native environment in the CD3 complex (and optionally fused to a heterologous amino acid sequence such as EpCAM or an immunoglobulin Fc part).

The present invention, therefore, provides for a bispecific single chain antibody molecule comprising a first binding domain capable of binding to an epitope of an N-terminal 1-27 amino acid residue polypeptide fragment of the extracellular domain of CD3 epsilon (which CD3 epsilon is, for example, taken out of its native environment and/or comprised by (presented on the surface of) a T-cell) of human and at least one non-chimpanzee primate CD3 epsilon chain, wherein the epitope is part of an amino acid sequence comprised in the group consisting of SEQ ID NOs. 2, 4, 6, and 8; and a second binding domain capable of binding to prostate-specific membrane antigen (PSMA). Preferred non-chimpanzee primates are mentioned herein elsewhere. At least one (or a selection thereof or all) primate(s) selected from *Callithrix jacchus; Saguinus oedipus, Saimiri sciureus,* and *Macaca fascicularis* (either SEQ ID 427 or 428 or both), is (are) particularly preferred. *Macaca mulatta,* also known as Rhesus Monkey is also envisaged as another preferred primate. It is thus envisaged that antibodies of the invention bind to (are capable of binding to) the context independent epitope of an N-terminal 1-27 amino acid residue polypeptide fragment of the extracellular domain of CD3 epsilon of human and *Callithrix jacchus, Saguinus oedipus, Saimiri sciureus*, and *Macaca fascicularis* (either SEQ ID 427 or 428 or both), and optionally also to *Macaca mulatta*. A bispecific single chain antibody molecule comprising a first binding domain as defined herein can be obtained (is obtainable by) or can be manufactured in accordance with the protocol set out in the appended Examples (in particular Example 2). To this end, it is envisaged to (a) immunize mice with an N-terminal 1-27 amino acid residue polypeptide fragment of the extracellular domain of CD3 epsilon of human and/or *Saimiri sciureus*; (b) generation of an immune murine antibody scFv library; (c) identification of CD3 epsilon specific binders by testing the capability to bind to at least SEQ ID NOs. 2, 4, 6, and 8.

The context-independence of the CD3 epitope provided in this invention corresponds to the first 27 N-terminal amino acids of CD3 epsilon or functional fragments of this 27 amino acid stretch. The phrase "context-independent," as used herein in relation to the CD3 epitope means that binding of the herein described inventive binding molecules/antibody molecules does not lead to a change or modification of the conformation, sequence, or structure surrounding the antigenic determinant or epitope. In contrast, the CD3 epitope recognized by a conventional CD3 binding molecule (e.g. as disclosed in WO 99/54440 or WO 04/106380) is localized on the CD3 epsilon chain C-terminally to the N-terminal 1-27 amino acids of the context-independent epitope, where it only takes the correct conformation if it is embedded within the rest of the epsilon chain and held in the right sterical position by heterodimerization of the epsilon chain with either the CD3 gamma or delta chain. Anti-CD3 binding molecules as part of a bispecific single chain antibody molecule as provided herein and generated (and directed) against a context-independent CD3 epitope provide for a surprising clinical improvement with regard to T cell redistribution and, thus, a more favourable safety profile. Without being bound by theory, since the CD3 epitope is context-independent, forming an autonomous selfsufficient subdomain without much influence on the rest of the CD3 complex, the CD3 binding molecules provided herein induce less allosteric changes in CD3 conformation than the conventional CD3 binding molecules, which recognize context-dependent CD3 epitopes (e.g. as disclosed in WO 99/54440 or WO 04/106380).

The context-independence of the CD3 epitope which is recognized by the CD3 binding domain of the bispecific single chain antibody of the invention is associated with less or no T cell redistribution (T cell redistribution equates with an initial episode of drop and subsequent recovery of absolute T cell counts) during the starting phase of treatment with said bispecific single chain antibody of the invention. This results in a better safety profile of the bispecific single chain antibody of the invention compared to conventional CD3 binding molecules known in the art, which recognize context-dependent CD3 epitopes. Particularly, because T cell redistribution during the starting phase of treatment with CD3 binding molecules is a major risk factor for adverse events, like CNS adverse events, the bispecific single chain antibody of the invention has a substantial safety advantage over the CD3 binding molecules known in the art by recognizing a context-independent rather than a context-dependent CD3 epitope. Patients with such CNS adverse events related to T cell redistribution during the starting phase of treatment with conventional CD3 binding molecules usually suffer from confusion and disorientation, in some cases also from urinary incontinence. Confusion is a change in mental status in which the patient is not able to think with his or her usual level of clarity. The patient usually has difficulties to concentrate and thinking is not only blurred and unclear but often significantly slowed down. Patients with CNS adverse events related to T cell redistribution during the starting phase of treatment with conventional CD3 binding molecules may also suffer from loss of memory. Frequently, the confusion leads to the loss of ability to recognize people, places, time or dates. Feelings of disorientation are common in confusion, and the decision-making ability is impaired. CNS adverse events related to T cell redistribution during the starting phase of treatment with conventional CD3 binding molecules may further comprise blurred speech and/or word finding difficulties. This disorder may impair both, the expression and understanding of language as well as reading and writing. Besides urinary incontinence, vertigo and dizziness may also accompany CNS adverse events related to T cell redistribution during the starting phase of treatment with conventional CD3 binding molecules in some patients.

The maintenance of the three-dimensional structure within the mentioned 27 amino acid N-terminal polypeptide fragment of CD3 epsilon can be used for the generation of, preferably human, binding domains which are capable of binding to the N-terminal CD3 epsilon polypeptide fragment in vitro and to the native (CD3 epsilon subunit of the) CD3 complex on T cells in vivo with the same binding affinity. These data strongly indicate that the N-terminal fragment as described herein forms a tertiary conformation, which is similar to its structure normally existing in vivo. A very sensitive test for the importance of the structural integrity of the amino acids 1-27 of the N-terminal polypeptide fragment of CD3 epsilon was performed. Individual amino acids of amino acids 1-27 of the N-terminal polypeptide fragment of CD3 epsilon were changed to alanine (alanine scanning) to test the sensitivity of the amino acids 1-27 of the N-terminal polypeptide fragment of CD3 epsilon for minor disruptions. The CD3 binding domains as part of the bispecific single chain antibody of the invention were used to test for binding to the alanine-mutants of amino acids 1-27 of the N-terminal polypeptide fragment of CD3 epsilon (see appended Example 5). Individual exchanges of the first five amino acid residues at the very N-terminal end of the fragment and two of the amino acids at positions 23 and 25 of the amino acids 1-27 of the N-terminal polypeptide fragment of CD3 epsilon were critical for binding of the antibody molecules. The substitution of amino acid residues in the region of position 1-5 comprising the residues Q (Glutamine at position 1), D (Aspartic acid at position 2), G (Glycine at position 3), N (Asparagine at position 4), and E (Glutamic acid at position 5) to Alanine abolished binding of the single domain bispecific single chain antibody of the invention to said fragment. While, for at least some of the single domain bispecific single chain antibody of the invention, two amino acid residues at the C-terminus of the mentioned fragment T (Threonine at position 23) and I (Isoleucine at position 25) reduced the binding energy to the single domain bispecific single chain antibody of the invention.

Unexpectedly, it has been found that the thus isolated bispecific single chain antibody of the invention not only recognizes the human N-terminal fragment of CD3 epsilon, but also the corresponding homologous fragments of CD3 epsilon of various primates, including New-World Monkeys (Marmoset, *Callithrix jacchus; Saguinus oedipus; Saimiri sciureus*) and Old-World Monkeys (*Macaca fascicularis*, also known as Cynomolgus Monkey; or *Macaca mulatta*, also known as Rhesus Monkey). Thus, multi-primate specificity of the bispecific single chain antibody of the invention was detected. The following sequence analyses confirmed that human and primates share a highly homologous sequence stretch at the N-terminus of the extracellular domain of CD3 epsilon.

The amino acid sequence of the aforementioned N-terminal fragments of CD3 epsilon are depicted in SEQ ID No. 2 (human), SEQ ID No. 4 (*Callithrix jacchus*); SEQ ID No. 6 (*Saguinus oedipus*); SEQ ID No. 8 (*Saimiri sciureus*); SEQ ID No. 427 QDGNEEMGSITQTPYQVSISGTTILTC or SEQ ID No. 428 QDGNEEMGSITQTPYQVSISGTT-VILT (*Macaca fascicularis*, also known as Cynomolgus Monkey), and SEQ ID No. 429 QDGNEEMGSITQTPYHV-SISGTTVILT (*Macaca mulatta*, also known as Rhesus Monkey).

The second binding domain of the single domain bispecific single chain antibody of the invention binds to a human or a non-chimpanzee primate tumor target antigen; more preferred it binds to the human tumor target antigen and a non-chimpanzee primate tumor target antigen and therefore is cross-species specific; even more preferred to the human tumor target antigen and the macaque tumor target antigen (and therefore is cross-species specific as well). Particularly preferred, the macaque target antigen is the Cynomolgus monkey tumor target antigen and/or the Rhesus monkey tumor target antigen. However, it is not excluded from the scope of the present invention, that the second binding domain may also bind to tumor target antigen homologs of other species, such as to the tumor target antigen homolog in rodents. Preferably, the tumor target antigen bound by the second binding domain of the bispecific antibody of the invention is EGFR, CD44v6 or CD30.

EGFR (also known as c-erb1 or HER1) belongs to the erbB receptor tyrosine kinase family. When activated by binding of a ligand from the EGF family of growth factors, EGFR homodimerizes or heterodimerizes with a second EGFR or another member of the erbB receptor family, respectively, initiating a signaling cascade through mitogen-activated protein kinases and other transcription factors leading to proliferation, differentiation and repair (Olayioye, EMBO J. 19 (2000), 3159-67). EGFR is overexpressed in many epithelial cancers, including colorectal, breast, lung, and head and neck cancers (Mendelsohn, J. Clin. Oncol. 21 (2003), 2787-99; Mendelsohn, J. Clin. Oncol. 20 (18, Suppl.) (2002), 1S-13S; Prewett, Clin. Cancer Res. 8 (2002), 994-1003). Overexpression and/or mutation of EGFR in malignant cells leads to constitutive activation of kinase activity resulting in proliferation, angiogenesis, invasion, metastasis, and inhibition of apoptosis (Mendelsohn (2003, loc. cit.; Ciardiello, Clin. Cancer Res. 7 (2001), 2958-70; Perez-Soler, Oncologist 9 (2004), 58-67). Monoclonal antibodies that target the extracellular ligand binding domain or the intracellular tyrosine kinase signaling cascade of EGFR have been shown efficacy as antitumor target (Laskin, Cancer Treat. Review 30 (2004), 1-17). For example, cetuximab (Erbitux®) a humanized monoclonal antibody to EGFR, which competitively inhibits the extracellular domain of EGFR to inhibit ligand activation of the receptor, was approved by the Food and Drug Administration (FDA) in 2004 for the treatment of metastatic colon cancer in combination with the topoisomerase inhibitor irinotecan.

CD30 (also known as Tumor necrosis factor receptor superfamily member 8 (TNFRSF8) or Lymphoid activation antigen) is expressed by activated, but not by resting, B or T cells. In the absence of CD30 signaling, activated lymphoid cells which are not eliminated via CD95-stimulation (apoptosis) gain the ability to proliferate extensively upon secondary encounter with antigen on parenchymal tissues, such as the pancreatic islets. Thus, CD30 signaling is understood to limit the proliferative potential of autoreactive CD8 effector T cells, and protects the body against autoimmunity. The cDNA of CD30 was cloned by Durkop et al. (Cell 68 (3), 421-427 (1992) GenBank® Accession No: NM_001243). CD30 interacts with TRAF2 and TRAF5 and mediate the activation of nuclear factor kappa-B. Several chronic inflammatory skin diseases are associated with increased numbers of mast cells and increased expression of CD30. Moreover, the lymphoid activation antigen CD30 is expressed on the H-RS cells of classical Hodgkin's lyphoma. Currently, clinical investigations are focusing on two anti-CD30 monoclonal antibodies, the humanized SGN-30 monoclonal antibody and the fully human 5F11 monoclonal antibody. SGN-30, a chimeric anti-CD30 monoclonal antibody, has demonstrated antitumor activity in preclinical models of Hodgkin's lymphoma and anaplastic large cell lymphoma. MDX-060 is a fully human IgG1k monoclonal antibody that recognizes CD30 and mediates killing of Hodgkin's lymphoma and anaplastic large cell lymphoma cell lines in vitro and in xenograft tumor models (Klimm et al. Hematologica (2005) 90 (12):1680).

CD44 is also known as IN, LHR, MC56, MDU2, MDU3, MIC4, Pgp1, CDW44, CSPG8, HCELL, MUTCH-1, ECMR-III or MGC10468. Accession numbers can be found in GenBank® under e.g. NM_000610. The human CD44 gene encodes type 1 transmembrane glycoproteins involved in cell-cell and cell-matrix interactions. The structural heterogeneity of the gene products is caused primarily by alternative splicing of at least 10 out of 20 exons. Certain CD44 variant isoforms, in particular those containing CD44 variant domain 6 (CD44v6), have been implicated in tumourigenesis, tumour cell invasion and metastasis. CD44v6 expression in human malignancies (primary epithelial and nonepithelial tumours as well as metastases) and normal tissues, and several examples of the clinical use of CD44v6-specific antibodies are reviewed in Heider et al. (Cancer Immunology, Immunotherapy (2004) 53(7):567-79). In nonmalignant tissues, CD44v6 expression is essentially restricted to a subset of epithelia. Intense and homogeneous expression of CD44v6 was reported for the majority of squamous cell carcinomas and a proportion of adenocarcinomas of differing origin, but was rarely seen in nonepithelial tumours. This expression pattern has made CD44v6 an attractive target for antibody-guided therapy of various types of epithelium-derived cancers.

Advantageously, the present invention provides also single domain bispecific single chain antibodies comprising a second binding domain which binds both to the human tumor target antigen and to the macaque tumor target antigen homolog, i.e. the homolog of a non-chimpanzee primate. In a preferred embodiment, the bispecific single chain antibody thus comprises a second binding domain exhibiting cross-species specificity to the human and a non-chimpanzee primate tumor target antigen. In this case, the identical bispecific single chain antibody molecule can be used both for preclinical evaluation of safety, activity and/or pharmacokinetic profile of these binding domains in primates and as drugs in humans. Put in other words, the same molecule can be used in preclinical animal studies as well as in clinical studies in humans. This leads to highly comparable results and a much-increased predictive power of the animal studies compared to species-specific surrogate molecules. Since both the CD3 and the second binding domain of the single domain bispecific single chain antibody of the invention are cross-species specific, i.e. reactive with the human and non-chimpanzee primates, it can be used both for preclinical evaluation of safety, activity and/or pharmacokinetic profile of these binding domains in primates and—in the identical form—as drugs in humans. It will be understood that in a preferred embodiment, the cross-species specificity of the first and second binding domain of the antibodies of the invention is identical.

It has been found in the present invention that it is possible to generate a single domain bispecific single chain antibody wherein the identical molecule can be used in preclinical animal testing, as well as clinical studies and even in therapy in human. This is due to the unexpected identification of the single domain bispecific single chain antibody, which, in addition to binding to human CD3 epsilon and tumor target antigen, respectively, (and due to genetic similarity likely to the chimpanzee counterpart), also binds to the homologs of said antigens of non-chimpanzee primates, including New-World Monkeys and Old-World Monkeys. As shown in the following examples, said single domain bispecific single chain antibody of the invention can be used as therapeutic agent or drug against various diseases, including, but not limited, to cancer. The single domain bispecific single chain antibody is particularly advantageous for the therapy of cancer. In view of the above, the need to construct a surrogate single domain bispecific single chain antibody for testing in a phylogenetic distant (from humans) species disappears. As a result, the identical molecule can be used in animal preclinical testing as is intended to be administered to humans in clinical testing as well as following market approval and therapeutic drug administration. The ability to use the same molecule for preclinical animal testing as in later administration to humans virtually eliminates, or at least greatly reduces, the danger that the data obtained in preclinical animal testing have limited applicability to the human case. In short, obtaining preclinical safety data in animals using the same molecule as will actually be administered to humans does much to ensure the applicability of the data to a human-relevant scenario. In contrast, in conventional approaches using surrogate molecules, said surrogate molecules have to be molecularly adapted to the animal test system used for preclinical safety assessment. Thus, the molecule to be used in human therapy in fact differs in sequence and also likely in structure from the surrogate molecule used in preclinical testing in pharmacokinetic parameters and/or biological activity, with the consequence that data obtained in preclinical animal testing have limited applicability/transferability to the human case. The use of surrogate molecules requires the construction, production, purification and characterization of a completely new construct. This leads to additional development costs and time necessary to obtain that molecule. In sum, surrogates have to be developed separately in addition to the actual drug to be used in human therapy, so that two lines of development for two molecules have to be carried out. Therefore, a major advantage of the single domain bispecific single chain antibody of the invention exhibiting cross-species specificity described herein is that the identical molecule can be used for therapeutics in humans and in preclinical animal testing.

It is preferred that at least one of said first or second binding domains of the bispecific single chain antibody of the invention is CDR-grafted, humanized or human, as set forth in more detail below. Preferably, both the first and second binding domains of the bispecific single chain antibody of the invention are CDR-grafted, humanized or human. For the single domain bispecific single chain antibody of the invention, the generation of an immune reaction against said binding molecules is excluded to the maximum possible extent upon administration of the molecule to human patients.

Another major advantage of the single domain bispecific single chain antibody of the invention is its applicability for preclinical testing in various primates. The behavior of a drug candidate in animals should ideally be indicative of the expected behavior of this drug candidate upon administration to humans. As a result, the data obtained from such preclinical testing should therefore generally have a highly predictive power for the human case. However, as learned from the tragic outcome of the recent Phase I clinical trial on TGN1412 (a CD28 monoclonal antibody), a drug candidate may act differently in a primate species than in humans: Whereas in preclinical testing of said antibody no or only limited adverse effects have been observed in animal studies performed with cynomolgus monkeys, six human patients developed multiple organ failure upon administration of said antibody (Lancet 368 (2006), 2206-7). The results of these dramatic, non-desired negative events suggest that it may not be sufficient to limit preclinical testing to only one (non-chimpanzee primate) species. The fact that the single domain bispecific single chain antibody of the invention binds to a series of New-World and Old-World Monkeys may help to overcome the problems faced in the case mentioned above. Accordingly, the present invention provides means and methods for minimizing species differences in effects when drugs for human therapy are being developed and tested.

With the cross-species specific single domain bispecific single chain antibody of the invention it is also no longer necessary to adapt the test animal to the drug candidate intended for administration to humans, such as e.g. the creation of transgenic animals. The single domain bispecific single chain antibody of the invention exhibiting cross-species specificity according to the uses and the methods of invention can be directly used for preclinical testing in non-chimpanzee primates, without any genetic manipulation of the animals. As well known to those skilled in the art, approaches in which the test animal is adapted to the drug candidate always bear the risk that the results obtained in the preclinical safety testing are less representative and predictive for humans due to the modification of the animal. For example, in transgenic animals, the proteins encoded by the transgenes are often highly over-expressed. Thus, data obtained for the biological activity of an antibody against this protein antigen may be limited in their predictive value for humans in which the protein is expressed at much lower, more physiological levels.

A further advantage of the uses of the single domain bispecific single chain antibody of the invention exhibiting cross-species specificity is the fact that chimpanzees as an endangered species are avoided for animal testing. Chimpanzees are the closest relatives to humans and were recently grouped into the family of hominids based on the genome sequencing data (Wildman et al., PNAS 100 (2003), 7181). Therefore, data obtained with chimpanzee is generally considered to be highly predictive for humans. However, due to their status as endangered species, the number of chimpanzees, which can be used for medical experiments, is highly restricted. As stated above, maintenance of chimpanzees for animal testing is therefore both costly and ethically problematic. The uses of the single domain bispecific single chain antibody of the invention avoid both ethical objections and financial burden during preclinical testing without prejudicing the quality, i.e. applicability, of the animal testing data obtained. In light of this, the uses of the single domain bispecific single chain antibody of the invention provide for a reasonable alternative for studies in chimpanzees.

A further advantage of the single domain bispecific single chain antibody of the invention is the ability of extracting multiple blood samples when using it as part of animal preclinical testing, for example in the course of pharmacokinetic animal studies. Multiple blood extractions can be much more readily obtained with a non-chimpanzee primate than with lower animals, e.g. a mouse. The extraction of multiple blood samples allows continuous testing of blood parameters for the determination of the biological effects induced by the single domain bispecific single chain antibody of the invention. Furthermore, the extraction of multiple blood samples enables the researcher to evaluate the pharmacokinetic profile of the single domain bispecific single chain antibody of the invention as defined herein. In addition, potential side effects, which may be induced by said single domain bispecific single chain antibody of the invention reflected in blood parameters can be measured in different blood samples extracted during the course of the administration of said antibody. This allows the determination of the potential toxicity profile of the single domain bispecific single chain antibody of the invention as defined herein.

The advantages of the single domain bispecific single chain antibody of the invention as defined herein exhibiting cross-species specificity may be briefly summarized as follows:

First, the single domain bispecific single chain antibody of the invention as defined herein used in preclinical testing is the same as the one used in human therapy. Thus, it is no longer necessary to develop two independent molecules, which may differ in their pharmacokinetic properties and biological activity. This is highly advantageous in that e.g. the pharmacokinetic results are more directly transferable and applicable to the human setting than e.g. in conventional surrogate approaches.

Second, the uses of the single domain bispecific single chain antibody of the invention as defined herein for the preparation of therapeutics in human is less cost- and labor-intensive than surrogate approaches.

Third, the single domain bispecific single chain antibody of the invention as defined herein can be used for preclinical testing not only in one primate species, but in a series of different primate species, thereby limiting the risk of potential species differences between primates and human.

Fourth, chimpanzee as an endangered species for animal testing can be avoided if desired.

Fifth, multiple blood samples can be extracted for extensive pharmacokinetic studies.

Sixth, due to the human origin of the binding molecules according to a preferred embodiment of the invention the generation of an immune reaction against said binding molecules is minimalized when administered to human patients. Induction of an immune response with antibodies specific for a drug candidate derived from a non-human species as e.g. a mouse leading to the development of human-anti-mouse antibodies (HAMAs) against therapeutic molecules of murine origin is excluded.

Last but not least, the therapeutic use of the single domain bispecific single chain antibody of the invention provides a novel and inventive therapeutic approach for cancer. The following examples clearly demonstrate the potent recruitment of cytotoxic activity of human and macaque effector cells against cells positive for a tumor target antigen.

As noted herein above, the present invention provides polypeptides, i.e. bispecific single chain antibodies, comprising a first binding domain consisting of one or two antibody variable domains capable of binding to an epitope of human and non-chimpanzee primate CD3ε chain and a second binding domain consisting of one or two antibody variable domains capable of binding to a tumor target antigen, wherein the second binding domain preferably also binds to a tumor target antigen of a human and a non-chimpanzee primate. The advantage of bispecific single chain antibody molecules as drug candidates fulfilling the requirements of the preferred bispecific single chain antibody of the invention is the use of such molecules in preclinical animal testing as well as in clinical studies and even for therapy in human. In a preferred embodiment of the cross-species specific bispecific single chain antibodies of the invention the second binding domain binding to a cell surface antigen is human. In a cross-species specific bispecific molecule according to the invention the binding domain binding to an epitope of human and non-chimpanzee primate CD3 epsilon chain is located in the order VH-VL or VL-VH or VHH or VH at the N-terminus or the C-terminus of the bispecific molecule. Examples for cross-species specific bispecific molecules according to the invention in different arrangements of the VH- and the VL-chain and the VHH chain consisting of one or two antibody variable domains in the first and the second binding domain are described in the appended examples.

As used herein, a "bispecific single chain antibody" denotes a single polypeptide chain comprising two binding domains. For example, each binding domain comprises one variable region from an antibody heavy chain ("VH region"), wherein the VH region of the first binding domain specifically binds to the CD3ε molecule, and the VH region of the second binding domain specifically binds to a tumor target antigen. Alternatively, each binding domain comprises one VHH region, wherein the VHH region of the first binding domain specifically binds to the CD3ε molecule, and the VHH region of the second binding domain specifically binds to a tumor target antigen. The two binding domains are optionally linked to one another by a short polypeptide spacer. A non-limiting example for a polypeptide spacer is Gly-Gly-Gly-Gly-Ser (G-G-G-G-S) (SEQ ID NO. 431) and repeats thereof. Each binding domain may in addition to a VH region as described above comprise one variable region from an antibody light chain ("VL region"), the VH region and VL region within each of the first or second binding domains being linked to one another via a polypeptide linker, for example of the type disclosed and claimed in EP 623679 B1, but in any case long enough to allow the VH region and VL region of the first binding domain and the VH region and VL region of the second binding domain to pair with one another such that, together, they are able to specifically bind to the respective first and second binding domains. Preferred formats for the bispecific single chain antibody of the invention are for example VH tumor target antigen-VL tumor target antigen-VHH CD3 or VL tumor target antigen-VH tumor target antigen-VHH CD3 or VHH tumor target antigen-VH CD3-VL-CD3.

The term "protein" is well known in the art and describes biological compounds. Proteins comprise one or more amino acid chains (polypeptides), whereby the amino acids are bound among one another via a peptide bond. The term "polypeptide" as used herein describes a group of molecules, which consists of more than 30 amino acids. In accordance with the invention, the group of polypeptides comprises "proteins" as long as the proteins consist of a single polypeptide chain. Also in line with the definition the term "polypeptide" describes fragments of proteins as long as these fragments consist of more than 30 amino acids. Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "polypeptide" and "protein" also refer to naturally modified polypeptides/proteins wherein the modification is effected e.g. by post-translational modifications like glycosylation, acetylation, phosphorylation and the like. Such modifications are well known in the art.

The term "binding domain" characterizes in connection with the present invention a domain of a polypeptide which specifically binds to/interacts with a given target structure/antigen/epitope. Thus, the binding domain is an "antigen-interaction-site". The term "antigen-interaction-site" defines, in accordance with the present invention, a motif of a polypeptide, which is able to specifically interact with a specific antigen or tumor target antigen or a specific group of antigens, e.g. the identical antigen or tumor target antigen in different species. Said binding/interaction is also understood to define a "specific recognition". The term "specifically recognizing" means in accordance with this invention that the antibody molecule is capable of specifically interacting with and/or binding to at least two, preferably at least three, more preferably at least four amino acids of an antigen, e.g. the human CD3 antigen as defined herein. Such binding may be exemplified by the specificity of a "lock-and-key-principle". Thus, specific motifs in the amino acid sequence of the binding domain and the antigen bind to each other as a result of their primary, secondary or tertiary structure as well as the result of secondary modifications of said structure. The specific interaction of the antigen-interaction-site with its specific antigen may result as well in a simple binding of said site to the antigen. Moreover, the specific interaction of the binding domain/antigen-interaction-site with its specific antigen may alternatively result in the initiation of a signal, e.g. due to the induction of a change of the conformation of the antigen, an oligomerization of the antigen, etc. A preferred example of a binding domain in line with the present invention is an antibody. The binding domain may be a monoclonal or polyclonal antibody or derived from a monoclonal or polyclonal antibody.

The term "antibody" comprises derivatives or functional fragments thereof which still retain the binding specificity. Techniques for the production of antibodies are well known in the art and described, e.g. in Harlow and Lane "Antibodies, A Laboratory Manual", Cold Spring Harbor Laboratory Press, 1988 and Harlow and Lane "Using Antibodies: A Laboratory Manual" Cold Spring Harbor Laboratory Press, 1999. The term "antibody" also comprises immunoglobulins (Ig's) of different classes (i.e. IgA, IgG, IgM, IgD and IgE) and subclasses (such as IgG1, IgG2 etc.).

The definition of the term "antibody" also includes embodiments such as chimeric, single chain and humanized antibodies, as well as antibody fragments, like, inter alia, Fab fragments. Antibody fragments or derivatives further comprise $F(ab')_2$, Fv, scFv fragments or single domain antibodies, single variable domain antibodies or immunoglobulin single variable domain comprising merely one variable domain, which might be VH or VL, that specifically bind to an antigen or epitope independently of other V regions or domains; see, for example, Harlow and Lane (1988) and (1999), loc. cit. Such immunoglobulin single variable domain encompasses not only an isolated antibody single variable domain polypeptide, but also larger polypeptides that comprise one or more monomers of an antibody single variable domain polypeptide sequence.

Various procedures are known in the art and may be used for the production of such antibodies and/or fragments. Thus, the (antibody) derivatives can also be produced by peptidomimetics. Further, techniques described for the production of single chain antibodies (see, inter alia, U.S. Pat. No. 4,946,778) can be adapted to produce single chain antibodies specific for elected polypeptide(s). Also, transgenic animals may be used to express humanized antibodies specific for polypeptides and fusion proteins of this invention. For the preparation of monoclonal antibodies, any technique, providing antibodies produced by continuous cell line cultures can be used. Examples for such techniques include the hybridoma technique (Kohler and Milstein Nature 256 (1975), 495-497), the trioma technique, the human B-cell hybridoma technique (Kozbor, Immunology Today 4 (1983), 72) and the EBV-hybridoma technique to produce human monoclonal antibodies (Cole et al., Monoclonal Antibodies and Cancer Therapy, Alan R. Liss, Inc. (1985), 77-96). Surface plasmon resonance as employed in the BIAcore® system can be used to increase the efficiency of phage antibodies which bind to an epitope of a target polypeptide, such as CD3 epsilon or a tumor target antigen (Schier, Human Antibodies Hybridomas 7 (1996), 97-105; Malmborg, J. Immunol. Methods 183 (1995), 7-13). It is also envisaged in the context of this invention that the term "antibody" comprises antibody constructs, which may be expressed in a host as described herein below, e.g. antibody constructs which may be transfected and/or transduced via, inter alia, viruses or plasmid vectors.

The term "specific interaction" as used in accordance with the present invention means that the binding domain does not or does not significantly cross-react with polypeptides which have similar structure as those bound by the binding domain, and which might be expressed by the same cells as the polypeptide of interest. Cross-reactivity of a panel of binding domains under investigation may be tested, for example, by assessing binding of said panel of binding domains under conventional conditions (see, e.g., Harlow and Lane, Antibodies: A Laboratory Manual, Cold Spring Harbor Laboratory Press, 1988 and Using Antibodies: A Laboratory Manual, Cold Spring Harbor Laboratory Press, 1999). Examples for the specific interaction of a binding domain with a specific antigen comprise the specificity of a ligand for its receptor. Said definition particularly comprises the interaction of ligands, which induce a signal upon binding to its specific receptor. Examples for said interaction, which is also particularly comprised by said definition, is the interaction of an antigenic determinant (epitope) with the binding domain (antigenic binding site) of an antibody.

The term "cross-species specificity" or "interspecies specificity" as used herein means binding of a binding domain described herein to the same target molecule in humans and non-chimpanzee primates. Thus, "cross-species specificity" or "interspecies specificity" is to be understood as an interspecies reactivity to the same molecule "X" (i.e. the homolog) expressed in different species, but not to a molecule other than "X". Cross-species specificity of a monoclonal antibody recognizing e.g. human CD3 epsilon, to a non-chimpanzee primate CD3 epsilon, e.g. macaque CD3 epsilon, can be determined, for instance, by fluorescence-activated cell sorting (FACS) analysis. The FACS analysis is carried out in a way that the respective monoclonal antibody is tested for binding to human and non-chimpanzee primate cells, e.g. macaque cells, expressing said human and non-chimpanzee primate CD3 epsilon antigens, respectively. An appropriate assay is shown in the following examples. The above-mentioned subject matter applies mutatis mutandis for the tumor target antigen: Cross-species specificity of a monoclonal antibody recognizing human tumor target antigen, to a non-chimpanzee primate tumor target antigen, e.g. macaque tumor target antigen, can be determined, for instance, by FACS analysis. The FACS analysis is carried out in a way that the respective monoclonal antibody is tested for binding to human and non-chimpanzee primate cells, e.g. macaque cells, expressing said human and non-chimpanzee primate tumor target antigens, respectively. Preferably, the tumor target antigen bound by the second binding domain of the bispecific antibody of the invention is EGFR, CD44v6 or CD30.

As used herein, CD3 epsilon denotes a molecule expressed as part of the T cell receptor and has the meaning as typically ascribed to it in the prior art. In human, it encompasses in individual or independently combined form all known CD3 subunits, for example CD3 epsilon, CD3 delta, CD3 gamma, CD3 zeta, CD3 alpha and CD3 beta. The non-chimpanzee primate, non-human CD3 antigens as referred to herein are, for example, *Macaca fascicularis* CD3 and *Macaca mulatta* CD3. In *Macaca fascicularis*, it encompasses CD3 epsilon FN-18 negative and CD3 epsilon FN-18 positive, CD3 gamma and CD3 delta. In *Macaca mulatta*, it encompasses CD3 epsilon, CD3 gamma and CD3 delta. Preferably, said CD3 as used herein is CD3 epsilon.

The human CD3 epsilon is indicated in GenBank® Accession No. NM_000733 and comprises SEQ ID NO. 1. The human CD3 gamma is indicated in GenBank® Accession NO. NM_000073. The human CD3 delta is indicated in GenBank® Accession No. NM_000732.

The CD3 epsilon "FN-18 negative" of *Macaca fascicularis* (i.e. CD3 epsilon not recognized by monoclonal antibody FN-18 due to a polymorphism as set forth above) is indicated in GenBank® Accession No. AB073994.

The CD3 epsilon "FN-18 positive" of *Macaca fascicularis* (i.e. CD3 epsilon recognized by monoclonal antibody FN-18) is indicated in GenBank® Accession No. AB073993. The CD3 gamma of *Macaca fascicularis* is indicated in GenBank® Accession No. AB073992. The CD3 delta of *Macaca fascicularis* is indicated in GenBank® Accession No. AB073991.

The nucleic acid sequences and amino acid sequences of the respective CD3 epsilon, gamma and delta homologs of *Macaca mulatta* can be identified and isolated by recombinant techniques described in the art (Sambrook et al. Molecular Cloning: A Laboratory Manual; Cold Spring Harbor Laboratory Press, 3$^{rd}$ edition 2001). This applies mutatis mutandis to the CD3 epsilon, gamma and delta homologs of other non-chimpanzee primates as defined herein. The identification of the amino acid sequence of *Callithrix jacchus, Saimiri sciureus* und *Saguinus oedipus* is described in the appended examples. The amino acid sequence of the extracellular domain of the CD3 epsilon of *Callithrix jacchus* is depicted in SEQ ID NO: 3, the one of *Saguinus oedipus* is depicted in SEQ ID NO: 5 and the one of *Saimiri sciureus* is depicted in SEQ ID NO: 7.

The accession number of EGFR, CD44v6 and CD30 have been indicated above. On the basis of this sequence information it is possible for the person skilled in the art without any inventive ado to clone (and express) the macaque tumor target antigen. For example, the human EGFR cDNA or a fragment thereof indicated in the above-mentioned GenBank® Accession No. can be used as a hybridization probe in order to screen a macaque cDNA library (e.g. a cDNA library of Cynomolgus monkey or Rhesus monkey) under appropriate hybridization conditions. Recombinant techniques and screening methods (including hybridization approaches) in molecular biology are described e.g. in Sambrook et al. Molecular Cloning: A Laboratory Manual; Cold Spring Harbor Laboratory Press, 3$^{rd}$ edition 2001.

In line with the above, the term "epitope" defines an antigenic determinant, which is specifically bound/identified by a binding domain as defined herein. The binding domain may specifically bind to/interact with conformational or continuous epitopes, which are unique for the target structure, e.g. the human and non-chimpanzee primate CD3 epsilon chain or the human and non-chimpanzee primate tumor target antigen. A conformational or discontinuous epitope is characterized for polypeptide antigens by the presence of two or more discrete amino acid residues which are separated in the primary sequence, but come together on the surface of the molecule when the polypeptide folds into the native protein/antigen (Sela, (1969) Science 166, 1365 and Laver, (1990) Cell 61, 553-6). The two or more discrete amino acid residues contributing to the epitope are present on separate sections of one or more polypeptide chain(s). These residues come together on the surface of the molecule when the polypeptide chain(s) fold(s) into a three-dimensional structure to constitute the epitope. In contrast, a continuous or linear epitope consists of two or more discrete amino acid residues, which are present in a single linear segment of a polypeptide chain. Within the present invention, a "context-dependent" CD3 epitope refers to the conformation of said epitope. Such a context-dependent epitope, localized on the epsilon chain of CD3, can only develop its correct conformation if it is embedded within the rest of the epsilon chain and held in the right position by heterodimerization of the epsilon chain with either CD3 gamma or delta chain. In contrast, a context-independent CD3 epitope as provided herein refers to an N-terminal 1-27 amino acid residue polypeptide or a functional fragment thereof of CD3 epsilon. This N-terminal 1-27 amino acid residue polypeptide or a functional fragment thereof maintains its three-dimensional structural integrity and correct conformation when taken out of its native environment in the CD3 complex. The context-independency of the N-terminal 1-27 amino acid residue polypeptide or a functional fragment thereof, which is part of the extracellular domain of CD3 epsilon, represents, thus, an epitope which is completely different to the epitopes of CD3 epsilon described in connection with a method for the preparation of human binding molecules in WO 2004/106380. Said method used solely expressed recombinant CD3 epsilon. The conformation of this solely expressed recombinant CD3 epsilon differed from that adopted in its natural form, that is, the form in which the CD3 epsilon subunit of the TCR/CD3 complex exists as part of a noncovalent complex with either the CD3 delta or the CD3-gamma subunit of the TCR/CD3 complex. When such solely expressed recombinant CD3 epsilon protein is used as an antigen for selection of antibodies from an antibody library, antibodies specific for this antigen are identified from the library although such a library does not contain antibodies with specificity for self-antigens/autoantigens. This is due to the fact that solely expressed recombinant CD3 epsilon protein does not exist in vivo; it is not an autoantigen. Consequently, subpopulations of B cells expressing antibodies specific for this protein have not been depleted in vivo; an antibody library constructed from such B cells would contain genetic material for antibodies specific for solely expressed recombinant CD3 epsilon protein.

However, since the context-independent N-terminal 1-27 amino acid residue polypeptide or a functional fragment thereof is an epitope, which folds in its native form, binding domains in line with the present invention cannot be identified by methods based on the approach described in WO 2004/106380. Therefore, it could be verified in tests that binding molecules as disclosed in WO 2004/106380 are not capable of binding to the N-terminal 1-27 amino acid residues of the CD3 epsilon chain. Hence, conventional anti-CD3 binding molecules or anti-CD3 antibody molecules (e.g. as disclosed in WO 99/54440) bind CD3 epsilon chain at a position which is more C-terminally located than the context-independent N-terminal 1-27 amino acid residue polypeptide or a functional fragment provided herein. Prior art antibody molecules OKT3 and UCHT-1 have also a specificity for the epsilon-subunit of the TCR/CD3 complex between amino acid residues 35 to 85 and, accordingly, the epitope of these antibodies is also more C-terminally located. In addition, UCHT-1 binds to the CD3 epsilon chain in a region between amino acid residues 43 to 77 (Tunnacliffe, Int. Immunol. 1 (1989), 546-50; Kjer-Nielsen, PNAS 101, (2004), 7675-7680; Salmeron, J. Immunol. 147 (1991), 3047-52). Therefore, prior art anti-CD3 molecules do not bind to and are not directed against the herein defined context-independent N-terminal 1-27 amino acid residue epitope (or a functional fragment thereof). In particular, the state of the art fails to provide anti-CD3 molecules which specifically binds to the context-independent N-terminal 1-27 amino acid residue epitope and which are cross-species specific, i.e. bind to human and non-chimpanzee primate CD3 epsilon.

For the generation of a binding domain consisting of one or two antibody variable domains comprised in a bispecific single chain antibody molecule of the invention, e.g. monoclonal antibodies binding to both the human and non-chimpanzee primate CD3 epsilon (e.g. macaque CD3 epsilon) or monoclonal antibodies binding to the human and/or non-chimpanzee primate tumor target antigen can be used.

As used herein, "human" and "man" refers to the species *Homo sapiens*. As far as the medical uses of the constructs described herein are concerned, human patients are to be treated with the same molecule.

It is preferred that at least one of said first or second binding domains of the bispecific single chain antibody of the invention is CDR-grafted, humanized or human. Preferably, both the first and second binding domains of the bispecific single chain antibody of the invention are CDR-grafted, humanized or human.

The term "human" antibody as used herein is to be understood as meaning that the bispecific single chain antibody as defined herein, comprises (an) amino acid sequence(s) contained in the human germline antibody repertoire. For the purposes of definition herein, said bispecific single chain antibody may therefore be considered human if it consists of such (a) human germline amino acid sequence (s), i.e. if the amino acid sequence(s) of the bispecific single chain antibody in question is (are) identical to (an) expressed human germline amino acid sequence(s). A bispecific single chain antibody as defined herein may also be regarded as human if it consists of (a) sequence(s) that deviate(s) from its (their) closest human germline sequence(s) by no more than would be expected due to the imprint of somatic hypermutation. Additionally, the antibodies of many non-human mammals, for example rodents such as mice and rats, comprise VH CDR3 amino acid sequences which one may expect to exist in the expressed human antibody repertoire as well. Any such sequence(s) of human or non-human origin which may be expected to exist in the expressed human repertoire would also be considered "human" for the purposes of the present invention.

As used herein, the term "humanized", "humanization", "human-like" or grammatically related variants thereof are used interchangeably to refer to a bispecific single chain antibody comprising in at least one of its binding domains at least one complementarity determining region ("CDR") from a non-human antibody or fragment thereof. Humanization approaches are described for example in WO 91/09968 and U.S. Pat. No. 6,407,213. As non-limiting examples, the term encompasses the case in which a variable region of at least one binding domain comprises a single CDR region, for example the third CDR region of the VH (CDRH3), from another non-human animal, for example a rodent, as well as the case in which a or both variable region/s comprise at each of their respective first, second and third CDRs the CDRs from said non-human animal. In the event that all CDRs of a binding domain of the bispecific single chain antibody have been replaced by their corresponding equivalents from, for example, a rodent, one typically speaks of "CDR-grafting", and this term is to be understood as being encompassed by the term "humanized" or grammatically related variants thereof as used herein. The term "humanized" or grammatically related variants thereof also encompasses cases in which, in addition to replacement of one or more CDR regions within a VH and/or VL of the first and/or second binding domain further mutation/s (e.g. substitutions) of at least one single amino acid residue/s within the framework ("FR") regions between the CDRs has/have been effected such that the amino acids at that/those positions correspond/s to the amino acid/s at that/those position/s in the animal from which the CDR regions used for replacement is/are derived. As is known in the art, such individual mutations are often made in the framework regions following CDR-grafting in order to restore the original binding affinity of the non-human antibody used as a CDR-donor for its target molecule. The term "humanized" may further encompass (an) amino acid substitution(s) in the CDR regions from a non-human animal to the amino acid(s) of a corresponding CDR region from a human antibody, in addition to the amino acid substitutions in the framework regions as described above.

As used herein, the term "homolog" or "homology" is to be understood as follows: Homology among proteins and DNA is often concluded on the basis of sequence similarity, especially in bioinformatics. For example, in general, if two or more genes have highly similar DNA sequences, it is likely that they are homologous. But sequence similarity may arise from different ancestors: short sequences may be similar by chance, and sequences may be similar because both were selected to bind to a particular protein, such as a transcription factor. Such sequences are similar but not homologous. Sequence regions that are homologous are also called conserved. This is not to be confused with conservation in amino acid sequences in which the amino acid at a specific position has changed but the physio-chemical properties of the amino acid remain unchanged. Homologous sequences are of two types: orthologous and paralogous. Homologous sequences are orthologous if they were separated by a speciation event: when a species diverges into two separate species, the divergent copies of a single gene in the resulting species are said to be orthologous. Orthologs, or orthologous genes, are genes in different species that are similar to each other because they originated from a common ancestor. The strongest evidence that two similar genes are orthologous is the result of a phylogenetic analysis of the gene lineage. Genes that are found within one clade are orthologs, descended from a common ancestor. Orthologs often, but not always, have the same function. Orthologous sequences provide useful information in taxonomic classification studies of organisms. The pattern of genetic divergence can be used to trace the relatedness of organisms. Two organisms that are very closely related are likely to display very similar DNA sequences between two orthologs. Conversely, an organism that is further removed evolutionarily from another organism is likely to display a greater divergence in the sequence of the orthologs being studied. Homologous sequences are paralogous if they were separated by a gene duplication event: if a gene in an organism is duplicated to occupy two different positions in the same genome, then the two copies are paralogous. A set of sequences that are paralogous are called paralogs of each other. Paralogs typically have the same or similar function, but sometimes do not: due to lack of the original selective pressure upon one copy of the duplicated gene, this copy is free to mutate and acquire new functions. An example can be found in rodents such as rats and mice. Rodents have a pair of paralogous insulin genes, although it is unclear if any divergence in function has occurred. Paralogous genes often belong to the same species, but this is not necessary: for example, the hemoglobin gene of humans and the myoglobin gene of chimpanzees are paralogs. This is a common problem in bioinformatics: when genomes of different species have been sequenced and homologous genes have been found, one can not immediately conclude that these genes have the same or similar function, as they could be paralogs whose function has diverged.

As used herein, a "non-chimpanzee primate" or "non-chimp primate" or grammatical variants thereof refers to any primate animal (i.e. not human) other than chimpanzee, i.e. other than an animal of belonging to the genus *Pan*, and including the species *Pan paniscus* and *Pan troglodytes*, also known as *Anthropopithecus troglodytes* or *Simia satyrus*. It will be understood, however, that it is possible that the antibodies of the invention can also bind with their first and/or second binding domain to the respective epitopes/fragments etc. of said chimpanzees. The intention is merely to avoid animal tests which are carried out with chimpanzees, if desired. It is thus also envisaged that in another embodiment the antibodies of the present invention also bind with their first and/or second binding domain to the respective epitopes of chimpanzees. A "primate", "primate species", "primates" or grammatical variants thereof denote/s an order of eutherian mammals divided into the two suborders of prosimians and anthropoids and comprising apes, monkeys and lemurs. Specifically, "primates" as used herein comprises the suborder Strepsirrhini (non-tarsier prosimians), including the infraorder Lemuriformes (itself including the superfamilies Cheirogaleoidea and Lemuroidea), the infraorder Chiromyiformes (itself including the family Daubentoniidae) and the infraorder Lorisiformes (itself including the families Lorisidae and Galagidae). "Primates" as used herein also comprises the suborder Haplorrhini, including the infraorder Tarsiiformes (itself including the family Tarsiidae), the infraorder Simiiformes (itself including the Platyrrhini, or New-World monkeys, and the Catarrhini, including the Cercopithecidea, or Old-World Monkeys).

The non-chimpanzee primate species may be understood within the meaning of the invention to be a lemur, a tarsier, a gibbon, a marmoset (belonging to New-World Monkeys of the family Cebidae) or an Old-World Monkey (belonging to the superfamily Cercopithecoidea).

As used herein, an "Old-World Monkey" comprises any monkey falling in the superfamily Cercopithecoidea, itself subdivided into the families: the Cercopithecinae, which are mainly African but include the diverse genus of macaques which are Asian and North African; and the Colobinae, which include most of the Asian genera but also the African colobus monkeys.

Specifically, within the subfamily Cercopithecinae, an advantageous non-chimpanzee primate may be from the Tribe Cercopithecini, within the genus *Allenopithecus* (Allen's Swamp Monkey, *Allenopithecus nigroviridis*); within the genus *Miopithecus* (Angolan Talapoin, *Miopithecus talapoin*; Gabon Talapoin, *Miopithecus ogouensis*); within the genus *Erythrocebus* (Patas Monkey, *Erythrocebus patas*); within the genus *Chlorocebus* (Green Monkey, *Chlorocebus sabaceus*; Grivet, *Chlorocebus aethiops*; Bale Mountains Vervet, *Chlorocebus djamdjamensis*; Tantalus Monkey, *Chlorocebus tantalus*; Vervet Monkey, *Chlorocebus pygerythrus*; Malbrouck, *Chlorocebus cynosuros*); or within the genus *Cercopithecus* (Dryas Monkey or Salongo Monkey, *Cercopithecus dryas*; Diana Monkey, *Cercopithecus diana*; Roloway Monkey, *Cercopithecus roloway*; Greater Spot-nosed Monkey, *Cercopithecus nictitans*; Blue Monkey, *Cercopithecus mitis*; Silver Monkey, *Cercopithecus doggetti*; Golden Monkey, *Cercopithecus kandti*; Sykes's Monkey, *Cercopithecus albogularis*; Mona Monkey, *Cercopithecus mona*; Campbell's Mona Monkey, *Cercopithecus campbelli*; Lowe's Mona Monkey, *Cercopithecus lowei*; Crested Mona Monkey, *Cercopithecus pogonias*; Wolf's Mona Monkey, *Cercopithecus wolfi*; Dent's Mona Monkey, *Cercopithecus denti*; Lesser Spot-nosed Monkey, *Cercopithecus petaurista*; White-throated Guenon, *Cercopithecus erythrogaster*; Sclater's Guenon, *Cercopithecus sclateri*; Red-eared Guenon, *Cercopithecus erythrotis*; Moustached Guenon, *Cercopithecus cephus*; Red-tailed Monkey, *Cercopithecus ascanius*; L'Hoest's Monkey, *Cercopithecus lhoesti*; Preuss's Monkey, *Cercopithecus preussi*; Sun-tailed Monkey, *Cercopithecus solatus*; Hamlyn's Monkey or Owl-faced Monkey, *Cercopithecus hamlyni*; De Brazza's Monkey, *Cercopithecus neglectus*).

Alternatively, an advantageous non-chimpanzee primate, also within the subfamily Cercopithecinae but within the Tribe *Papionini*, may be from within the genus *Macaca* (Barbary Macaque, *Macaca sylvanus*; Lion-tailed Macaque, *Macaca silenus*; Southern Pig-tailed Macaque or Beruk, *Macaca nemestrina*; Northern Pig-tailed Macaque, *Macaca leonina*; Pagai Island Macaque or Bokkoi, *Macaca pagensis*; Siberut Macaque, *Macaca siberu*; Moor Macaque, *Macaca maura*; Booted Macaque, *Macaca ochreata*; Tonkean Macaque, *Macaca tonkeana*; Heck's Macaque, *Macaca hecki*; Gorontalo Macaque, *Macaca nigriscens*; Celebes Crested Macaque or Black "Ape", *Macaca nigra*; Cynomolgus monkey or Crab-eating Macaque or Long-tailed Macaque or Kera, *Macaca fascicularis*; Stump-tailed Macaque or Bear Macaque, *Macaca arctoides*; Rhesus Macaque, *Macaca mulatta*; Formosan Rock Macaque, *Macaca cyclopis*; Japanese Macaque, *Macaca fuscata*; Toque Macaque, *Macaca sinica*; Bonnet Macaque, *Macaca radiata*; Barbary Macaque, *Macaca sylvanmus*; Assam Macaque, *Macaca assamensis*; Tibetan Macaque or Milne-Edwards' Macaque, *Macaca thibetana*; Arunachal Macaque or Munzala, *Macaca munzala*); within the genus *Lophocebus* (Gray-cheeked Mangabey, *Lophocebus albigena; Lophocebus albigena albigena; Lophocebus albigena osmani; Lophocebus albigena johnstoni*; Black Crested Mangabey, *Lophocebus aterrimus*; Opdenbosch's Mangabey, *Lophocebus opdenboschi*; Highland Mangabey, *Lophocebus kipunji*); within the genus *Papio* (Hamadryas Baboon, *Papio hamadryas*; Guinea Baboon, *Papio papio*; Olive Baboon, *Papio anubis*; Yellow Baboon, *Papio cynocephalus*; Chacma Baboon, *Papio ursinus*); within the genus *Theropithecus* (Gelada, *Theropithecus gelada*); within the genus *Cercocebus* (Sooty Mangabey, *Cercocebus atys; Cercocebus atys atys; Cercocebus atys lunulatus*; Collared Mangabey, *Cercocebus torquatus*; Agile Mangabey, *Cercocebus agilis*; Golden-bellied Mangabey, *Cercocebus chrysogaster*; Tana River Mangabey, *Cercocebus galeritus*; Sanje Mangabey, *Cercocebus sanjei*); or within the genus *Mandrillus* (Mandrill, *Mandrillus sphinx*; Drill, *Mandrillus leucophaeus*).

Most preferred is *Macaca fascicularis* (also known as Cynomolgus monkey and, therefore, in the Examples named "Cynomolgus") and *Macaca mulatta* (rhesus monkey, named "rhesus").

Within the subfamily Colobinae, an advantageous non-chimpanzee primate may be from the African group, within the genus *Colobus* (Black Colobus, *Colobus satanas*; Angola Colobus, *Colobus angolensis*; King Colobus, *Colobus polykomos*; Ursine Colobus, *Colobus vellerosus*; Mantled Guereza, *Colobus guereza*); within the genus *Piliocolobus* (Western Red Colobus, *Piliocolobus badius; Piliocolobus badius badius; Piliocolobus badius temminckii; Piliocolobus badius waldronae*; Pennant's Colobus, *Piliocolobus pennantii; Piliocolobus pennantii pennantii; Piliocolobus pennantii epieni; Piliocolobus pennantii bouvieri*; Preuss's Red Colobus, *Piliocolobus preussi*; Thollon's Red Colobus, *Piliocolobus tholloni*; Central African Red Colobus, *Piliocolobus foai; Piliocolobus foai foai; Piliocolobus foai ellioti; Piliocolobus foai oustaleti; Piliocolobus foai semlikiensis; Piliocolobus foai parmentierorum*; Ugandan Red Colobus, *Piliocolobus tephrosceles*; Uzyngwa Red Colobus, *Piliocolobus gordonorum*; Zanzibar Red Colobus, *Piliocolobus kirkii*; Tana River Red Colobus, *Piliocolobus rufomitratus*); or within the genus *Procolobus* (Olive Colobus, *Procolobus verus*).

Within the subfamily Colobinae, an advantageous non-chimpanzee primate may alternatively be from the Langur (leaf monkey) group, within the genus *Semnopithecus* (Nepal Gray Langur, *Semnopithecus schistaceus*; Kashmir Gray Langur, *Semnopithecus ajax*; Tarai Gray Langur, *Semnopithecus hector*; Northern Plains Gray Langur, *Semnopithecus entellus*; Black-footed Gray Langur, *Semnopithecus hypoleucos*; Southern Plains Gray Langur, *Semnopithecus dussumieri*; Tufted Gray Langur, *Semnopithecus priam*); within the *T. vetulus* group or the genus *Trachypithecus* (Purple-faced Langur, *Trachypithecus vetulus*; Nilgiri Langur, *Trachypithecus johnii*); within the *T. cristatus* group of the genus *Trachypithecus* (Javan Lutung, *Trachypithecus auratus*; Silvery Leaf Monkey or Silvery Lutung, *Trachypithecus cristatus*; Indochinese Lutung, *Trachypithecus germaini*; Tenasserim Lutung, *Trachypithecus barbei*); within the *T. obscurus* group of the genus *Trachypithecus* (Dusky Leaf Monkey or Spectacled Leaf Monkey, *Trachypithecus obscurus*; Phayre's Leaf Monkey, *Trachypithecus phayrei*); within the *T. pileatus* group of the genus *Trachypithecus* (Capped Langur, *Trachypithecus pileatus*; Shortridge's Langur, *Trachypithecus shortridgei*; Gee's Golden Langur, *Trachypithecus geei*); within the *T. francoisi* group of the genus *Trachypithecus* (Francois' Langur, *Trachypithecus francoisi*; Hatinh Langur, *Trachypithecus hatinhensis*; White-headed Langur, *Trachypithecus poliocephalus*; Laotian Langur, *Trachypithecus laotum*; Delacour's Langur, *Trachypithecus delacouri*; Indochinese Black Langur, *Trachypithecus ebenus*); or within the genus *Presbytis* (Sumatran Surili, *Presbytis melalophos*; Banded Surili, *Presbytis femoralis*; Sarawak Surili, *Presbytis chrysomelas*; White-thighed Surili, *Presbytis siamensis*; White-fronted Surili, *Presbytis frontata*; Javan Surili, *Presbytis comata*; Thomas's Langur, *Presbytis thomasi*; Hose's Langur, *Presbytis hosei*; Maroon Leaf Monkey, *Presbytis rubicunda*; Mentawai Langur or Joja, *Presbytis potenziani*; Natuna Island Surili, *Presbytis natunae*).

Within the subfamily Colobinae, an advantageous non-chimpanzee primate may alternatively be from the Odd-Nosed group, within the genus *Pygathrix* (Red-shanked Douc, *Pygathrix nemaeus*; Black-shanked Douc, *Pygathrix nigripes*; Gray-shanked Douc, *Pygathrix cinerea*); within the genus *Rhinopithecus* (Golden Snub-nosed Monkey, *Rhinopithecus roxellana*; Black Snub-nosed Monkey, *Rhinopithecus bieti*; Gray Snub-nosed Monkey, *Rhinopithecus brelichi*; Tonkin Snub-nosed Langur, *Rhinopithecus avunculus*); within the genus *Nasalis* (Proboscis Monkey, *Nasalis larvatus*); or within the genus *Simias* (Pig-tailed Langur, *Simias concolor*).

As used herein, the term "marmoset" denotes any New-World Monkeys of the genus *Callithrix*, for example belonging to the Atlantic marmosets of subgenus *Callithrix* (sic!) (Common Marmoset, *Callithrix (Callithrix) jacchus*; Black-tufted Marmoset, *Callithrix (Callithrix) penicillata*; Wied's Marmoset, *Callithrix (Callithrix) kuhlii*; White-headed Marmoset, *Callithrix (Callithrix) geoffroyi*; Buffy-headed Marmoset, *Callithrix (Callithrix) flaviceps*; Buffy-tufted Marmoset, *Callithrix (Callithrix) aurita*); belonging to the Amazonian marmosets of subgenus *Mico* (Rio Acari Marmoset, *Callithrix (Mico) acariensis*; Manicore Marmoset, *Callithrix (Mico) manicorensis*; Silvery Marmoset, *Callithrix (Mico) argentata*; White Marmoset, *Callithrix (Mico) leucippe*; Emilia's Marmoset, *Callithrix (Mico) emiliae*; Black-headed Marmoset, *Callithrix (Mico) nigriceps*; Marca's Marmoset, *Callithrix (Mico)marcai*; Black-tailed Marmoset, *Callithrix (Mico) melanura*; Santarem Marmoset, *Callithrix (Mico) humeralifera*; Maués Marmoset, *Callithrix (Mico) mauesi*; Gold-and-white Marmoset, *Callithrix (Mico) chrysoleuca*; Hershkovitz's Marmoset, *Callithrix (Mico) intermedia*; Satéré Marmoset, *Callithrix (Mico) saterei*); Roosmalens' Dwarf Marmoset belonging to the subgenus *Callibella* (*Callithrix (Callibella) humilis*); or the Pygmy Marmoset belonging to the subgenus *Cebuella* (*Callithrix (Cebuella) pygmaea*).

Other genera of the New-World Monkeys comprise tamarins of the genus *Saguinus* (comprising the *S. oedipus*-group, the *S. midas* group, the *S. nigricollis* group, the *S. mystax* group, the *S. bicolor* group and the *S. inustus* group) and squirrel monkeys of the genus *Samiri* (e.g. *Saimiri sciureus, Saimiri oerstedii, Saimiri ustus, Saimiri boliviensis, Saimiri vanzolini*)

In a preferred embodiment of the bispecific single chain antibody molecule of the invention, the non-chimpanzee primate is an old world monkey. In a more preferred embodiment of the polypeptide, the old world monkey is a monkey of the *Papio* genus Macaque genus. Most preferably, the monkey of the Macaque genus is Assamese macaque (*Macaca assamensis*), Barbary macaque (*Macaca sylvanus*), Bonnet macaque (*Macaca radiata*), Booted or Sulawesi-Booted macaque (*Macaca ochreata*), Sulawesi-crested macaque (*Macaca nigra*), Formosan rock macaque (*Macaca cyclopsis*), Japanese snow macaque or Japanese macaque (*Macaca fuscata*), Cynomologus monkey or crab-eating macaque or long-tailed macaque or Java macaque (*Macaca fascicularis*), Lion-tailed macaque (*Macaca silenus*), Pigtailed macaque (*Macaca nemestrina*), Rhesus macaque (*Macaca mulatta*), Tibetan macaque (*Macaca thibetana*), Tonkean macaque (*Macaca tonkeana*), Toque macaque (*Macaca sinica*), Stump-tailed macaque or Red-faced macaque or Bear monkey (*Macaca arctoides*), or Moor macaque (*Macaca maurus*). Most preferably, the monkey of the *Papio* genus is Hamadryas Baboon, *Papio hamadryas*; Guinea Baboon, *Papio papio*; Olive Baboon, *Papio anubis*; Yellow Baboon, *Papio cynocephalus*; Chacma Baboon, *Papio ursinus*.

In an alternatively preferred embodiment of the bispecific single chain antibody molecule of the invention, the non-chimpanzee primate is a new world monkey. In a more preferred embodiment of the polypeptide, the new world monkey is a monkey of the *Callithrix* genus (marmoset), the *Saguinus* genus or the *Samiri* genus. Most preferably, the monkey of the *Callithrix* genus is *Callithrix jacchus*, the monkey of the *Saguinus* genus is *Saguinus oedipus* and the monkey of the *Samiri* genus is *Saimiri sciureus.*

The term "cell surface antigen" as used herein denotes a molecule, which is displayed on the surface of a cell. In most cases, this molecule will be located in or on the plasma membrane of the cell such that at least part of this molecule remains accessible from outside the cell in tertiary form. A non-limiting example of a cell surface molecule, which is located in the plasma membrane is a transmembrane protein comprising, in its tertiary conformation, regions of hydrophilicity and hydrophobicity. Here, at least one hydrophobic region allows the cell surface molecule to be embedded, or inserted in the hydrophobic plasma membrane of the cell while the hydrophilic regions extend on either side of the plasma membrane into the cytoplasm and extracellular space, respectively. Non-limiting examples of cell surface molecules which are located on the plasma membrane are proteins which have been modified at a cysteine residue to bear a palmitoyl group, proteins modified at a C-terminal cysteine residue to bear a farnesyl group or proteins which have been modified at the C-terminus to bear a glycosyl phosphatidyl inositol ("GPI") anchor. These groups allow covalent attachment of proteins to the outer surface of the plasma membrane, where they remain accessible for recognition by extracellular molecules such as antibodies. An example of cell surface antigens is CD3 epsilon.

In light of this, tumor target antigens can also be characterized as a tumor antigens. The term "tumor target antigen" as used herein may be understood as those antigens that are presented on tumor cells. These antigens can be presented on the cell surface with an extracellular part, which is often combined with a transmembrane and cytoplasmic part of the molecule. These antigens can sometimes be presented only by tumor cells and never by the normal ones. Tumor antigens can be exclusively expressed on tumor cells or might represent a tumor specific mutation compared to normal cells. In this case, they are called tumor-specific antigens. More common are antigens that are presented by tumor cells and normal cells, and they are called tumor-associated antigens. These tumor-associated antigens can be overexpressed compared to normal cells or are accessible for antibody binding in tumor cells due to the less compact structure of the tumor tissue compared to normal tissue. Preferably, the tumor target antigen bound by the second binding domain of the bispecific antibody of the invention is EGFR, CD44v6 or CD30.

As described herein above the bispecific single chain antibody molecule of the invention binds with the first binding domain to an epitope of human and non-chimpanzee primate CD3ε (epsilon) chain, wherein the epitope is part of an amino acid sequence comprised in the group consisting of 27 amino acid residues as depicted in SEQ ID NOs. 2, 4, 6, or 8 or a functional fragment thereof.

In line with the present invention it is preferred for the bispecific single chain antibody molecule of the invention that said epitope is part of an amino acid sequence comprising 26, 25, 24, 23, 22, 21, 20, 19, 18, 17, 16, 15, 14, 13, 12, 11, 10, 9, 8, 7, 6 or 5 amino acids.

More preferably, wherein said epitope comprises at least the amino acid sequence Gln-Asp-Gly-Asn-Glu (Q-D-G-N-E).

Within the present invention, a functional fragment of the N-terminal 1-27 amino acid residues means that said functional fragment is still a context-independent epitope maintaining its three-dimensional structural integrity when taken out of its native environment in the CD3 complex (and fused to a heterologous amino acid sequence such as EpCAM or an immunoglobulin Fc part, e.g. as shown in Example 3.1). The maintenance of the three-dimensional structure within the 27 amino acid N-terminal polypeptide or functional fragment thereof of CD3 epsilon can be used for the generation of binding domains which bind to the N-terminal CD3 epsilon polypeptide fragment in vitro and to the native (CD3 epsilon subunit of the) CD3 complex on T cells in vivo with the same binding affinity. Within the present invention, a functional fragment of the N-terminal 1-27 amino acid residues means that CD3 binding domains provided herein can still bind to such functional fragments in a context-independent manner. The person skilled in the art is aware of methods for epitope mapping to determine which amino acid residues of an epitope are recognized by such anti-CD3 binding domains (e.g. alanine scanning; see appended examples).

Within the present invention it is further preferred that the second binding domain binds to the human tumor target antigen and/or a non-chimpanzee primate tumor target antigen. Particularly preferred, the second binding domain binds to the human tumor target antigen and a non-chimpanzee primate tumor target antigen, preferably a macaque tumor target antigen. It is to be understood, that the second binding domain binds to at least one non-chimpanzee primate tumor target antigen, however, it may also bind to two, three or more, non-chimpanzee primate tumor target antigen homologs. For example, the second binding domain may bind to a Cynomogus monkey tumor target antigen and to a Rhesus monkey tumor target antigen. Preferably, the tumor target antigen is EGFR, CD44v6 or CD30.

For the generation of the second binding domain of the bispecific single chain antibody molecule of the invention, e.g. bispecific single chain antibodies as defined herein, monoclonal antibodies binding to both of the respective human and/or non-chimpanzee primate cell surface tumor target antigen can be utilized. Appropriate binding domains for the bispecific polypeptide as defined herein e.g. can be derived from cross-species specific monoclonal antibodies by recombinant methods described in the art. A monoclonal antibody binding to a human cell surface antigen and to the homolog of said cell surface antigen in a non-chimpanzee primate can be tested by FACS assays as set forth above. It is evident to those skilled in the art that cross-species specific antibodies can also be generated by hybridoma techniques described in the literature (Milstein and Köhler, Nature 256 (1975), 495-7). For example, mice may be alternately immunized with human and non-chimpanzee primate cell surface antigen. From these mice, cross-species specific antibody-producing hybridoma cells are isolated via hybridoma technology and analysed by FACS as set forth above. The generation and analysis of bispecific polypeptides such as bispecific single chain antibodies exhibiting cross-species specificity as described herein is shown in the following examples. The advantages of the bispecific single chain antibodies exhibiting cross-species specificity include the points enumerated herein.

In the event that a tylopoda-derived antibody variable domain is used in the first and/or second portion of a bispecific antibody according to this embodiment of the invention, said first and/or second portion may advantageously be derived independently from camel, llama or/and dromedary. This use of such "camelid" antibodies allows the researcher seeking to develop or optimize bispecific antibodies according to this embodiment of the invention to capitalize on the unique types of antibodies known to be produced by these species. These species are namely known to produce high affinity antibodies of only a single variable domain. In the event that a tylopoda antibody is used as the source for the antibody variable domain in the first and/or second portion of the bispecific antibody, it is advantageous to use the VHH domain or a modified variant thereof.

The term "VHH" denotes a variable region of a heavy chain of a so-called "camelid" antibody. Camelid antibodies comprise a heavy chain, but lack a light chain. As such, a VHH region from such a camelid antibody represents the minimal structural element required to specifically bind to an antigen of interest in these species. Camelid VHH domains have been found to bind to antigen with high affinity (Desmyter et al. 2001. J Biol Chem 276, 26285-90) and possess high stability in solution (Ewert et al. 2002. Biochemistry 41, 3628-36).

In one embodiment of the invention, the bispecific single chain antibody molecule of the invention comprises a (first) binding domain consisting of one antibody variable domain capable of binding to an epitope of human and non-chimpanzee primate CD3 epsilon chain and a second binding domain consisting of an antibody variable domain capable of binding to a human and an non-chimpanzee tumor target antigen. Preferably, the tumor target antigen is EGFR, CD44v6 or CD30. The first binding domain is preferably a VH domain or a VHH domain. The second binding domain may comprise one antibody variable domain (preferably a VH or VHH domain) or two antibody variable domains (preferably a scFv, i.e. VH-VL or VL-VH). In a preferred embodiment, at least one of said first or second binding domain is CDR-grafted, humanized or human. In another preferred embodiment, at least one of said first or second binding domain is a VHH domain. Preferably, the antibody variable domain of the first binding domain of the bispecific antibody of the invention comprises CDR 1 of SEQ ID NO: 398, CDR 2 of SEQ ID NO. 399 and CDR 3 of SEQ ID NO. 400. Even more preferred, the first binding domain of the bispecific single chain antibody molecule comprises an antibody variable domain as shown in SEQ ID NO. 397 or an amino acid sequence at least 80%, more preferred at least 90% or 95% identical, most preferred at least 96% identical to the amino acid sequence of SEQ ID NO. 397.

In another embodiment of the invention, the bispecific single chain antibody molecule comprises a first binding domain capable of binding to an epitope of the human and non-chimpanzee primate CD3 epsilon chain, wherein the epitope is part of an amino acid sequence comprised in the group consisting of SEQ ID NOs. 2, 4, 6, and 8, and a second binding domain consisting of one antibody variable domain capable of binding to an epitope of a human and a non-chimpanzee primate tumor target antigen. Preferably, the tumor target antigen is EGFR, CD44v6 or CD30.

In this embodiment, the first binding domain comprises one (preferably a VH domain or a VHH domain) or two variable domains (preferably a scFv, i.e. VH-VL or VL-VH). In a preferred embodiment, at least one of said first or second binding domain is CDR-grafted, humanized or human. If the first binding domain of the bispecific single chain antibody molecule of the invention comprises two variable domains (VH-VL or VL-VH) it is preferred that the first binding domain capable of binding to an epitope of human and non-chimpanzee primate CD3ε chain comprises a VL region comprising CDR-L1, CDR-L2 and CDR-L3 selected from:
  (a) CDR-L1 as depicted in SEQ ID NO. 27, CDR-L2 as depicted in SEQ ID NO. 28 and CDR-L3 as depicted in SEQ ID NO. 29;
  (b) CDR-L1 as depicted in SEQ ID NO. 117, CDR-L2 as depicted in SEQ ID NO. 118 and CDR-L3 as depicted in SEQ ID NO. 119; and
  (c) CDR-L1 as depicted in SEQ ID NO. 153, CDR-L2 as depicted in SEQ ID NO. 154 and CDR-L3 as depicted in SEQ ID NO. 155.

The variable regions, i.e. the variable light chain ("L" or "VL") and the variable heavy chain ("H" or "VH") are understood in the art to provide the binding domain of an antibody. This variable regions harbor the complementarity determining regions. The term "complementarity determining region" (CDR) is well known in the art to dictate the antigen specificity of an antibody. The term "CDR-L" or "L CDR" or "LCDR" refers to CDRs in the VL, whereas the term "CDR-H" or "H CDR" or "HCDR" refers to the CDRs in the VH.

In an alternatively preferred embodiment of the bispecific single chain antibody molecule of the invention the first binding domain capable of binding to an epitope of human and non-chimpanzee primate CD3ε chain comprises a VH region comprising CDR-H1, CDR-H2 and CDR-H3 selected from:
  (a) CDR-H1 as depicted in SEQ ID NO. 12, CDR-H2 as depicted in SEQ ID NO. 13 and CDR-H3 as depicted in SEQ ID NO. 14;
  (b) CDR-H1 as depicted in SEQ ID NO. 30, CDR-H2 as depicted in SEQ ID NO. 31 and CDR-H3 as depicted in SEQ ID NO. 32;
  (c) CDR-H1 as depicted in SEQ ID NO. 48, CDR-H2 as depicted in SEQ ID NO. 49 and CDR-H3 as depicted in SEQ ID NO. 50;
  (d) CDR-H1 as depicted in SEQ ID NO. 66, CDR-H2 as depicted in SEQ ID NO. 67 and CDR-H3 as depicted in SEQ ID NO. 68;
  (e) CDR-H1 as depicted in SEQ ID NO. 84, CDR-H2 as depicted in SEQ ID NO. 85 and CDR-H3 as depicted in SEQ ID NO. 86;

(f) CDR-H1 as depicted in SEQ ID NO. 102, CDR-H2 as depicted in SEQ ID NO. 103 and CDR-H3 as depicted in SEQ ID NO. 104;
(g) CDR-H1 as depicted in SEQ ID NO. 120, CDR-H2 as depicted in SEQ ID NO. 121 and CDR-H3 as depicted in SEQ ID NO. 122;
(h) CDR-H1 as depicted in SEQ ID NO. 138, CDR-H2 as depicted in SEQ ID NO. 139 and CDR-H3 as depicted in SEQ ID NO. 140;
(i) CDR-H1 as depicted in SEQ ID NO. 156, CDR-H2 as depicted in SEQ ID NO. 157 and CDR-H3 as depicted in SEQ ID NO. 158; and
(j) CDR-H1 as depicted in SEQ ID NO. 174, CDR-H2 as depicted in SEQ ID NO. 175 and CDR-H3 as depicted in SEQ ID NO. 176.

It is further preferred that the binding domain capable of binding to an epitope of human and non-chimpanzee primate CD3ε chain comprises a VL region selected from the group consisting of a VL region as depicted in SEQ ID NO. 35, 39, 125, 129, 161 or 165.

It is alternatively preferred that the first binding domain capable of binding to an epitope of human and non-chimpanzee primate CD3ε chain comprises a VH region selected from the group consisting of a VH region as depicted in SEQ ID NO. 15, 19, 33, 37, 51, 55, 69, 73, 87, 91, 105, 109, 123, 127, 141, 145, 159, 163, 177 or 181.

More preferably, the bispecific single chain antibody molecule of the invention is characterized by the first binding domain capable of binding to an epitope of human and non-chimpanzee primate CD3ε chain, which comprises a VL region and a VH region selected from the group consisting of:
(a) a VL region as depicted in SEQ ID NO. 17 or 21 and a VH region as depicted in SEQ ID NO. 15 or 19;
(b) a VL region as depicted in SEQ ID NO. 35 or 39 and a VH region as depicted in SEQ ID NO. 33 or 37;
(c) a VL region as depicted in SEQ ID NO. 53 or 57 and a VH region as depicted in SEQ ID NO. 51 or 55;
(d) a VL region as depicted in SEQ ID NO. 71 or 75 and a VH region as depicted in SEQ ID NO. 69 or 73;
(e) a VL region as depicted in SEQ ID NO. 89 or 93 and a VH region as depicted in SEQ ID NO. 87 or 91;
(f) a VL region as depicted in SEQ ID NO. 107 or 111 and a VH region as depicted in SEQ ID NO. 105 or 109;
(g) a VL region as depicted in SEQ ID NO. 125 or 129 and a VH region as depicted in SEQ ID NO. 123 or 127;
(h) a VL region as depicted in SEQ ID NO. 143 or 147 and a VH region as depicted in SEQ ID NO. 141 or 145;
(i) a VL region as depicted in SEQ ID NO. 161 or 165 and a VH region as depicted in SEQ ID NO. 159 or 163; and
(j) a VL region as depicted in SEQ ID NO. 179 or 183 and a VH region as depicted in SEQ ID NO. 177 or 181.

According to a preferred embodiment of the bispecific single chain antibody molecule of the invention the pairs of VH-regions and VL-regions in the first binding domain binding to CD3 epsilon are in the format of a single chain antibody (scFv). The VH and VL regions are arranged in the order VH-VL or VL-VH. It is preferred that the VH-region is positioned N-terminally to a linker sequence. The VL-region is positioned C-terminally of the linker sequence. Put in other words, the domain arrangement in the CD3 binding domain of the bispecific single chain antibody molecule of the invention is preferably VH-VL, with said CD3 binding domain located C-terminally to the second (cell surface antigen) binding domain. Preferably the VH-VL comprises or is SEQ ID NO. 185.

A preferred embodiment of the above described bispecific single chain antibody molecule of the invention is characterized by the first binding domain capable of binding to an epitope of human and non-chimpanzee primate CD3ε chain comprising an amino acid sequence selected from the group consisting of SEQ ID NOs: 23, 25, 41, 43, 59, 61, 77, 79, 95, 97, 113, 115, 131,133, 149, 151, 167, 169, 185 or 187.

According to a preferred embodiment of the invention an above characterized bispecific single chain antibody molecule comprises a group of the following sequences as CDR1-3 in the second binding domain selected from the group consisting of:
(a) CDR 1 of SEQ ID NO: 376, CDR 2 of SEQ ID NO. 377 and CDR 3 of SEQ ID NO. 378; and
(b) CDR 1 of SEQ ID NO: 387, CDR 2 of SEQ ID NO. 388 and CDR 3 of SEQ ID NO. 389.

The sequences of the corresponding VL- and VH-regions of the second binding domain of the bispecific single chain antibody molecule of the invention as well as of the respective scFvs are shown in the sequence listing.

In the bispecific single chain antibody molecule of the invention the binding domains are arranged as exemplified in the appended examples.

A even more preferred embodiment of the invention concerns an above characterized bispecific single chain antibody, wherein the second binding domain comprises an antibody variable domain as shown in SEQ ID NO. 375 or 386 or an amino acid sequence at least 80%, more preferred at least 90% or 95% identical, most preferred at least 96% identical to the amino acid sequence of SEQ ID NO. 375 or 386.

A particularly preferred embodiment of the invention concerns a bispecific single chain antibody molecule, wherein the bispecific single chain antibody molecule comprises a sequence selected from:
(a) an amino acid sequence as depicted in any of SEQ ID NOs. 380, 382, 384, 391, 393 or 395;
(b) an amino acid sequence encoded by a nucleic acid sequence as depicted in any of SEQ ID NOs: 381, 383, 385, 392, 394 or 396; and
(c) an amino acid sequence at least 90% identical, more preferred at least 95% identical, most preferred at least 96% identical to the amino acid sequence of (a) or (b).

The invention relates to a bispecific single chain antibody molecule comprising an amino acid sequence as depicted in any of SEQ ID NOs: 380, 382, 384, 391, 393 or 395, as well as to an amino acid sequences at least 85% identical, preferably 90%, more preferred at least 95% identical, most preferred at least 96, 97, 98, or 99% identical to the amino acid sequence of SEQ ID NOs: 380, 382, 384, 391, 393 or 395. The invention relates also to the corresponding nucleic acid sequences as depicted in any of SEQ ID NOs: 381, 383, 385, 392, 394, or 396 as well as to nucleic acid sequences at least 85% identical, preferably 90%, more preferred at least 95% identical, most preferred at least 96, 97, 98, or 99% identical to the nucleic acid sequences shown in SEQ ID NOs: 381, 383, 385, 392, 394, or 396. It is to be understood that the sequence identity is determined over the entire nucleotide or amino acid sequence. For sequence alignments, for example, the programs Gap or BestFit can be used (Needleman and Wunsch J. Mol. Biol. 48 (1970), 443-453; Smith and Waterman, Adv. Appl. Math 2 (1981), 482-489), which is contained in the GCG software package (Genetics Computer Group, 575 Science Drive, Madison, Wisconsin, USA 53711 (1991). It is a routine method for those skilled in the art to determine and identify a nucleotide or amino acid sequence having e.g. 85% (90%, 95%, 96%, 97%, 98% or 99%) sequence identity to the nucleotide or amino acid sequences of the bispecific single single chain antibody of the invention. For example, according to Crick's Wobble hypothesis, the 5' base on the anti-codon is not as spatially confined as the other two bases, and could thus have non-standard base pairing. Put in other words: the third position in a codon triplet may vary so that two triplets which differ in this third position may encode the same amino acid residue. Said hypothesis is well known to the person skilled in the art (see e.g. http://en.wikipedia.org/wiki/Wobble_Hypothesis; Crick, J Mol Biol 19 (1966): 548-55).

Preferred domain arrangements in the single domain bispecific single chain antibody constructs of the invention are shown in the following examples.

In a preferred embodiment of the invention, the bispecific single chain antibodies are cross-species specific for CD3 epsilon and for human and non-chimpanzee primate tumor target antigens recognized by their second binding domain.

In an alternative embodiment the present invention provides a nucleic acid sequence encoding an above described bispecific single chain antibody molecule of the invention.

The present invention also relates to a vector comprising the nucleic acid molecule of the present invention.

Many suitable vectors are known to those skilled in molecular biology, the choice of which would depend on the function desired and include plasmids, cosmids, viruses, bacteriophages and other vectors used conventionally in genetic engineering. Methods which are well known to those skilled in the art can be used to construct various plasmids and vectors; see, for example, the techniques described in Sambrook et al. (loc cit.) and Ausubel, Current Protocols in Molecular Biology, Green Publishing Associates and Wiley Interscience, N.Y. (1989), (1994). Alternatively, the polynucleotides and vectors of the invention can be reconstituted into liposomes for delivery to target cells. As discussed in further details below, a cloning vector was used to isolate individual sequences of DNA. Relevant sequences can be transferred into expression vectors where expression of a particular polypeptide is required. Typical cloning vectors include pBluescript SK, pGEM, pUC9, pBR322 and pGBT9. Typical expression vectors include pTRE, pCAL-n-EK, pESP-1, pOP13CAT.

Preferably said vector comprises a nucleic acid sequence which is a regulatory sequence operably linked to said nucleic acid sequence defined herein.

The term "regulatory sequence" refers to DNA sequences, which are necessary to effect the expression of coding sequences to which they are ligated. The nature of such control sequences differs depending upon the host organism. In prokaryotes, control sequences generally include promoter, ribosomal binding site, and terminators. In eukaryotes generally control sequences include promoters, terminators and, in some instances, enhancers, transactivators or transcription factors. The term "control sequence" is intended to include, at a minimum, all components the presence of which are necessary for expression, and may also include additional advantageous components.

The term "operably linked" refers to a juxtaposition wherein the components so described are in a relationship permitting them to function in their intended manner. A control sequence "operably linked" to a coding sequence is ligated in such a way that expression of the coding sequence is achieved under conditions compatible with the control sequences. In case the control sequence is a promoter, it is obvious for a skilled person that double-stranded nucleic acid is preferably used.

Thus, the recited vector is preferably an expression vector. An "expression vector" is a construct that can be used to transform a selected host and provides for expression of a coding sequence in the selected host. Expression vectors can for instance be cloning vectors, binary vectors or integrating vectors. Expression comprises transcription of the nucleic acid molecule preferably into a translatable mRNA. Regulatory elements ensuring expression in prokaryotes and/or eukaryotic cells are well known to those skilled in the art. In the case of eukaryotic cells they comprise normally promoters ensuring initiation of transcription and optionally poly-A signals ensuring termination of transcription and stabilization of the transcript. Possible regulatory elements permitting expression in prokaryotic host cells comprise, e.g., the $P_L$, lac, trp or tac promoter in $E.$ $coli$, and examples of regulatory elements permitting expression in eukaryotic host cells are the AOX1 or GAL1 promoter in yeast or the CMV-, SV40-, RSV-promoter (Rous sarcoma virus), CMV-enhancer, SV40-enhancer or a globin intron in mammalian and other animal cells.

Beside elements, which are responsible for the initiation of transcription such regulatory elements may also comprise transcription termination signals, such as the SV40-poly-A site or the tk-poly-A site, downstream of the polynucleotide. Furthermore, depending on the expression system used leader sequences capable of directing the polypeptide to a cellular compartment or secreting it into the medium may be added to the coding sequence of the recited nucleic acid sequence and are well known in the art; see also the appended Examples. The leader sequence(s) is (are) assembled in appropriate phase with translation, initiation and termination sequences, and preferably, a leader sequence capable of directing secretion of translated protein, or a portion thereof, into the periplasmic space or extracellular medium. Optionally, the heterologous sequence can encode a fusion protein including an N-terminal identification peptide imparting desired characteristics, e.g., stabilization or simplified purification of expressed recombinant product; see supra. In this context, suitable expression vectors are known in the art such as Okayama-Berg cDNA expression vector pcDV1 (Pharmacia), pCDM8, pRc/CMV, pcDNA1, pcDNA3 (In-vitrogene), pEF-DHFR, pEF-ADA or pEF-neo (Mack et al. PNAS (1995) 92, 7021-7025 and Raum et al. Cancer Immunol Immunother (2001) 50(3), 141-150) or pSPORT1 (GIBCO BRL).

Preferably, the expression control sequences will be eukaryotic promoter systems in vectors capable of transforming of transfecting eukaryotic host cells, but control sequences for prokaryotic hosts may also be used. Once the vector has been incorporated into the appropriate host, the host is maintained under conditions suitable for high level expression of the nucleotide sequences, and as desired, the collection and purification of the bispecific single chain antibody molecule of the invention may follow; see, e.g., the appended examples.

An alternative expression system, which can be used to express a cell cycle interacting protein is an insect system. In one such system, *Autographa californica* nuclear polyhedrosis virus (AcNPV) is used as a vector to express foreign genes in *Spodoptera frugiperda* cells or in *Trichoplusia* larvae. The coding sequence of a recited nucleic acid molecule may be cloned into a nonessential region of the virus, such as the polyhedrin gene, and placed under control of the polyhedrin promoter. Successful insertion of said coding sequence will render the polyhedrin gene inactive and produce recombinant virus lacking coat protein coat. The recombinant viruses are then used to infect *S.* frugiperda cells or Trichoplusia larvae in which the protein of the invention is expressed (Smith, J. Virol. 46 (1983), 584; Engelhard, Proc. Nat. Acad. Sci. USA 91 (1994), 3224-3227).

Additional regulatory elements may include transcriptional as well as translational enhancers. Advantageously, the above-described vectors of the invention comprise a selectable and/or scorable marker.

Selectable marker genes useful for the selection of transformed cells and, e.g., plant tissue and plants are well known to those skilled in the art and comprise, for example, antimetabolite resistance as the basis of selection for dhfr, which confers resistance to methotrexate (Reiss, Plant Physiol. (Life Sci. Adv.) 13 (1994), 143-149); npt, which confers resistance to the aminoglycosides neomycin, kanamycin and paromycin (Herrera-Estrella, EMBO J. 2 (1983), 987-995) and hygro, which confers resistance to hygromycin (Marsh, Gene 32 (1984), 481-485). Additional selectable genes have been described, namely trpB, which allows cells to utilize indole in place of tryptophan; hisD, which allows cells to utilize histinol in place of histidine (Hartman, Proc. Natl. Acad. Sci. USA 85 (1988), 8047); mannose-6-phosphate isomerase which allows cells to utilize mannose (WO 94/20627) and ODC (ornithine decarboxylase) which confers resistance to the ornithine decarboxylase inhibitor, 2-(difluoromethyl)-DL-ornithine, DFMO (McConlogue, 1987, In: Current Communications in Molecular Biology, Cold Spring Harbor Laboratory ed.) or deaminase from *Aspergillus terreus* which confers resistance to Blasticidin S (Tamura, Biosci. Biotechnol. Biochem. 59 (1995), 2336-2338).

Useful scorable markers are also known to those skilled in the art and are commercially available. Advantageously, said marker is a gene encoding luciferase (Giacomin, Pl. Sci. 116 (1996), 59-72; Scikantha, J. Bact. 178 (1996), 121), green fluorescent protein (Gerdes, FEBS Lett. 389 (1996), 44-47) or B-glucuronidase (Jefferson, EMBO J. 6 (1987), 3901-3907). This embodiment is particularly useful for simple and rapid screening of cells, tissues and organisms containing a recited vector.

As described above, the recited nucleic acid molecule can be used alone or as part of a vector to express the bispecific single chain antibody molecule of the invention in cells, for, e.g., purification but also for gene therapy purposes. The nucleic acid molecules or vectors containing the DNA sequence(s) encoding any one of the above described bispecific single chain antibody molecule of the invention is introduced into the cells which in turn produce the polypeptide of interest. Gene therapy, which is based on introducing therapeutic genes into cells by ex-vivo or in-vivo techniques is one of the most important applications of gene transfer. Suitable vectors, methods or gene-delivery systems for in-vitro or in-vivo gene therapy are described in the literature and are known to the person skilled in the art; see, e.g., Giordano, Nature Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91 (1998), 30-36; Verma, Gene Ther. 5 (1998), 692-699; Nabel, Ann. N.Y. Acad. Sci. 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. Nos. 5,580,859; 5,589,466; or Schaper, Current Opinion in Biotechnology 7 (1996), 635-640; dos Santos Coura and Nardi Virol J. (2007), 4:99. The recited nucleic acid molecules and vectors may be designed for direct introduction or for introduction via liposomes, or viral vectors (e.g., adenoviral, retroviral) into the cell. Preferably, said cell is a germ line cell, embryonic cell, or egg cell or derived there from, most preferably said cell is a stem cell. An example for an embryonic stem cell can be, inter alia, a stem cell as described in Nagy, Proc. Natl. Acad. Sci. USA 90 (1993), 8424-8428.

The invention also provides for a host transformed or transfected with a vector of the invention. Said host may be produced by introducing the above described vector of the invention or the above described nucleic acid molecule of the invention into the host. The presence of at least one vector or at least one nucleic acid molecule in the host may mediate the expression of a gene encoding the above described single chain antibody constructs.

The described nucleic acid molecule or vector of the invention, which is introduced in the host may either integrate into the genome of the host or it may be maintained extrachromosomally.

The host can be any prokaryote or eukaryotic cell.

The term "prokaryote" is meant to include all bacteria, which can be transformed or transfected with DNA or RNA molecules for the expression of a protein of the invention. Prokaryotic hosts may include gram negative as well as gram positive bacteria such as, for example, *E. coli, S. typhimurium, Serratia marcescens* and *Bacillus subtilis*. The term "eukaryotic" is meant to include yeast, higher plant, insect and preferably mammalian cells. Depending upon the host employed in a recombinant production procedure, the protein encoded by the polynucleotide of the present invention may be glycosylated or may be non-glycosylated. Especially preferred is the use of a plasmid or a virus containing the coding sequence of the bispecific single chain antibody molecule of the invention and genetically fused thereto an N-terminal FLAG-tag and/or C-terminal His-tag. Preferably, the length of said FLAG-tag is about 4 to 8 amino acids, most preferably 8 amino acids. An above described polynucleotide can be used to transform or transfect the host using any of the techniques commonly known to those of ordinary skill in the art. Furthermore, methods for preparing fused, operably linked genes and expressing them in, e.g., mammalian cells and bacteria are well-known in the art (Sambrook, loc cit.). Preferably, said the host is a bacterium or an insect, fungal, plant or animal cell. It is particularly envisaged that the recited host may be a mammalian cell. Particularly preferred host cells comprise CHO cells, COS cells, myeloma cell lines like SP2/0 or NS/0. As illustrated in the appended examples, particularly preferred are CHO-cells as hosts.

More preferably said host cell is a human cell or human cell line, e.g. per.c6 (Kroos, Biotechnol. Prog., 2003, 19:163-168).

In a further embodiment, the present invention thus relates to a process for the production of a bispecific single chain antibody molecule of the invention, said process comprising culturing a host of the invention under conditions allowing the expression of the bispecific single chain antibody molecule of the invention and recovering the produced polypeptide from the culture.

The transformed hosts can be grown in fermentors and cultured according to techniques known in the art to achieve optimal cell growth. The bispecific single chain antibody molecule of the invention can then be isolated from the growth medium, cellular lysates, or cellular membrane fractions. The isolation and purification of the, e.g., microbially expressed bispecific single chain antibody molecules may be by any conventional means such as, for example, preparative chromatographic separations and immunological separations such as those involving the use of monoclonal or polyclonal antibodies directed, e.g., against a tag of the bispecific single chain antibody molecule of the invention or as described in the appended examples.

The conditions for the culturing of a host, which allow the expression are known in the art to depend on the host system and the expression system/vector used in such process. The parameters to be modified in order to achieve conditions allowing the expression of a recombinant polypeptide are known in the art. Thus, suitable conditions can be determined by the person skilled in the art in the absence of further inventive input.

Once expressed, the bispecific single chain antibody molecule of the invention can be purified according to standard procedures of the art, including ammonium sulfate precipitation, affinity columns, column chromatography, gel electrophoresis and the like; see, Scopes, "Protein Purification", Springer-Verlag, N.Y. (1982). Substantially pure polypeptides of at least about 90 to 95% homogeneity are preferred, and 98 to 99% or more homogeneity are most preferred, for pharmaceutical uses. Once purified, partially or to homogeneity as desired, the bispecific single chain antibody molecule of the invention may then be used therapeutically (including extracorporeally) or in developing and performing assay procedures. Furthermore, examples for methods for the recovery of the bispecific single chain antibody molecule of the invention from a culture are described in detail in the appended examples. The recovery can also be achieved by a method for the isolation of the bispecific single chain antibody molecule of the invention capable of binding to an epitope of human and non-chimpanzee primate CD3 epsilon (CD3ε), the method comprising the steps of:

(a) contacting the polypeptide(s) with an N-terminal fragment of the extracellular domain of CD3ε of maximal 27 amino acids comprising the amino acid sequence Gln-Asp-Gly-Asn-Glu-Glu-Met-Gly (SEQ ID NO. 341) or Gln-Asp-Gly-Asn-Glu-Glu-Ile-Gly (SEQ ID NO. 342), fixed via its C-terminus to a solid phase;

(b) eluting the bound polypeptide(s) from said fragment; and (c) isolating the polypeptide(s) from the eluate of (b).

It is preferred that the polypeptide(s) isolated by the above method of the invention are human.

This method or the isolation of the bispecific single chain antibody molecule of the invention is understood as a method for the isolation of one or more different polypeptides with the same specificity for the fragment of the extracellular domain of CD3ε comprising at its N-terminus the amino acid sequence Gln-Asp-Gly-Asn-Glu-Glu-Met-Gly (SEQ ID NO. 341) or Gln-Asp-Gly-Asn-Glu-Glu-Ile-Gly (SEQ ID NO. 342) from a plurality of polypeptide candidates as well as a method for the purification of a polypeptide from a solution. A non-limiting example for the latter method for the purification of a bispecific single chain antibody molecule from a solution is e.g. the purification of a recombinantly expressed bispecific single chain antibody molecule from a culture supernatant or a preparation from such culture. As stated above the fragment used in this method is an N-terminal fragment of the extracellular domain of the primate CD3ε molecule. The amino acid sequence of the extracellular domain of the CD3ε molecule of different species is depicted in SEQ ID NOs: 1, 3, 5 and 7. The two forms of the N-terminal octamer are depicted in SEQ ID NOs: 341 and 342. It is preferred that this N-terminus is freely available for binding of the polypeptides to be identified by the method of the invention. The term "freely available" is understood in the context of the invention as free of additional motives such as a His-tag. The interference of such a His-tag with a binding molecule identified by the method of the invention is described in the appended Examples 6 and 20.

According to this method said fragment is fixed via its C-terminus to a solid phase. The person skilled in the art will easily and without any inventive ado elect a suitable solid phase support dependent from the used embodiment of the method of the invention. Examples for a solid support comprise but are not limited to matrices like beads (e.g. agarose beads, Sepharose™ beads, Polystyrol® beads, dextran beads), plates (culture plates or MultiWell plates) as well as chips known e.g. from Biacore®. The selection of the means and methods for the fixation/immobilization of the fragment to said solid support depend on the election of the solid support. A commonly used method for the fixation/immobilization is a coupling via an N-hydroxysuccinimide (NHS) ester. The chemistry underlying this coupling as well as alternative methods for the fixation/immobilization are known to the person skilled in the art, e.g. from Hermanson "Bioconjugate Techniques", Academic Press, Inc. (1996). For the fixation to/immobilization on chromatographic supports the following means are commonly used: NHS-activated Sepharose™ (e.g. HiTrap®-NHS of GE Life Science-Amersham), CnBr-activated Sepharose™ (e.g. GE Life Science-Amersham), NHS-activated dextran beads (Sigma) or activated polymethacrylate. These reagents may also be used in a batch approach. Moreover, dextran beads comprising iron oxide (e.g. available from Miltenyi) may be used in a batch approach. These beads may be used in combination with a magnet for the separation of the beads from a solution. Polypeptides can be immobilized on a Biacore® chip (e.g. CM5 chips) by the use of NHS activated carboxymethyldextran. Further examples for an appropriate solid support are amine reactive MultiWell plates (e.g. Nunc Immobilizer™ plates).

According to this method said fragment of the extracellular domain of CD3 epsilon can be directly coupled to the solid support or via a stretch of amino acids, which might be a linker or another protein/polypeptide moiety. Alternatively, the extracellular domain of CD3 epsilon can be indirectly coupled via one or more adaptor molecule(s).

Means and methods for the eluation of a peptide or polypeptide bound to an immobilized epitope are well known in the art. The same holds true for methods for the isolation of the identified polypeptide(s) from the eluate.

A method for the isolation of one or more different bispecific single chain antibody molecule(s) with the same specificity for the fragment of the extracellular domain of CD3ε comprising at its N-terminus the amino acid sequence Gln-Asp-Gly-Asn-Glu-Glu-X-Gly (SEQ ID NO. 432) (with X being Met or Ile) from a plurality of polypeptide candidates may comprise one or more steps of the following methods for the selection of antigen-specific entities:

CD3ε specific binding domains can be selected from antibody derived repertoires. A phage display library can be constructed based on standard procedures, as for example disclosed in "Phage Display: A Laboratory Manual"; Ed. Barbas, Burton, Scott & Silverman; Cold Spring Harbor Laboratory Press, 2001. The format of the antibody fragments in the antibody library can be scFv, but may generally also be a Fab fragment or even a single domain antibody fragment. For the isolation of antibody fragments naïve antibody fragment libraries may be used. For the selection of potentially low immunogenic binding entities in later therapeutic use, human antibody fragment libraries may be favourable for the direct selection of human antibody fragments. In some cases they may form the basis for synthetic antibody libraries (Knappik et al. J Mol. Biol. 2000, 296:57 ff). The corresponding format may be Fab, scFv (as described below) or domain antibodies (dAbs, as reviewed in Holt et al., Trends Biotechnol. 2003, 21:484 ff).

It is also known in the art that in many cases there is no immune human antibody source available against the tumor target antigen. Therefore animals are immunized with the tumor target antigen and the respective antibody libraries isolated from animal tissue as e.g. spleen or PBMCs. The N-terminal fragment may be biotinylated or covalently linked to proteins like KLH or bovine serum albumin (BSA). According to common approaches rodents are used for immunization. Some immune antibody repertoires of non-human origin may be especially favourable for other reasons, e.g. for the presence of single domain antibodies (VHH) derived from cameloid species (as described in Muyldermans, J Biotechnol. 74:277; De Genst et al. Dev Como Immunol. 2006, 30:187 ff). Therefore a corresponding format of the antibody library may be Fab, scFv (as described below) or single domain antibodies (VHH).

In one possible approach ten weeks old F1 mice from balb/c×C57black crossings can be immunized with whole cells e.g. expressing transmembrane EpCAM N-terminally displaying as translational fusion the N-terminal amino acids 1 to 27 of the mature CD3ε chain. Alternatively, mice can be immunized with 1-27 CD3 epsilon-Fc fusion protein (a corresponding approach is described in the appended Example 2). After booster immunization(s), blood samples can be taken and antibody serum titer against the CD3-positive T cells can be tested e.g. in FACS analysis. Usually, serum titers are significantly higher in immunized than in non-immunized animals.

Immunized animals may form the basis for the construction of immune antibody libraries. Examples of such libraries comprise phage display libraries. Such libraries may be generally constructed based on standard procedures, as for example disclosed in "Phage Display: A Laboratory Manual"; Ed. Barbas, Burton, Scott & Silverman; Cold Spring Harbor Laboratory Press, 2001.

The non-human antibodies can also be humanized via phage display due to the generation of more variable antibody libraries that can be subsequently enriched for binders during selection.

In a phage display approach any one of the pools of phages that displays the antibody libraries forms a basis to select binding entities using the respective antigen as target molecule. The central step in which antigen specific, antigen bound phages are isolated is designated as panning. Due to the display of the antibody fragments on the surface of the phages, this general method is called phage display. One preferred method of selection is the use of small proteins such as the filamentous phage N2 domain translationally fused to the N-terminus of the scFv displayed by the phage. Another display method known in the art, which may be used to isolate binding entities is the ribosome display method (reviewed in Groves & Osbourn, Expert Opin Biol Ther. 2005, 5:125 ff; Lipovsek & Pluckthun, J Immunol Methods 2004, 290:52 ff). In order to demonstrate binding of scFv phage particles to a 1-27 CD3ε-Fc fusion protein a phage library carrying the cloned scFv-repertoire can be harvested from the respective culture supernatant by PEG (polyethyleneglycole). ScFv phage particles may be incubated with immobilized CD3ε Fc fusion protein. The immobilized CD3ε Fc fusion protein may be coated to a solid phase. Binding entities can be eluted and the eluate can be used for infection of fresh uninfected bacterial hosts. Bacterial hosts successfully transduced with a phagemid copy, encoding a human scFv-fragment, can be selected again for carbenicillin resistance and subsequently infected with e.g. VCMS 13 helper phage to start the second round of antibody display and in vitro selection. A total of 4 to 5 rounds of selections is carried out, normally. The binding of isolated binding entities can be tested on CD3 epsilon positive Jurkat cells, HBP-ALL cells, PBMCs or transfected eukaryotic cells that carry the N-terminal CD3ε sequence fused to surface displayed EpCAM using a flow cytometric assay (see appended Example 4).

Preferably, the above method may be a method, wherein the fragment of the extracellular domain of CD3ε consists of one or more fragments of a polypeptide having an amino acid sequence of any one depicted in SEQ ID NOs. 2, 4, 6 or 8. More preferably, said fragment is 8, 9, 10, 11, 12, 13, 14, 15, 16, 17, 18, 19, 20, 21, 22, 23, 24, 25, 26, or 27 amino acid residues in length.

This method of identification of a bispecific single chain antibody molecule may be a method of screening a plurality of bispecific single chain antibody molecules comprising a cross-species specific binding domain binding to an epitope of human and non-chimpanzee primate CD3ε. Alternatively, the method of identification is a method of purification/isolation of a bispecific single chain antibody molecule comprising a cross-species specific binding domain binding to an epitope of human and non-chimpanzee primate CD3ε.

Furthermore, the invention provides for a composition comprising a bispecific single chain antibody molecule of the invention or a bispecific single chain antibody as produced by the process disclosed above. Preferably, said composition is a pharmaceutical composition.

The invention provides also for a bispecific single chain antibody molecule as defined herein, or produced according to the process as defined herein, wherein said bispecific single chain antibody molecule is for use in the prevention, treatment or amelioration of cancer. Preferably, CD44v6× CD3 bispecific single chain antibodies of the invention can be used as therapeutic agents in order to treat squamous cell carcinoma. In particular, said CD44v6×CD3 bispecific single chain antibodies are useful to kill the migratory subset of colorectal carcinoma cells. Preferably, EGFR×CD3 bispecific single chain antibodies can be used as therapeutic agents in order to treat epithelial cancer. Preferably, CD30× CD3 bispecific single chain antibodies can be used as therapeutic agents in order to treat Hodgkin's lymphoma. It is preferred that the bispecific single chain is further comprising suitable formulations of carriers, stabilizers and/or excipients. Moreover, it is preferred that said bispecific single chain antibody molecule is suitable to be administered in combination with an additional drug. Said drug may be a non-proteinaceous compound or a proteinaceous compound and may be administered simultaneously or non-simultaneously with the bispecific single chain antibody molecule as defined herein.

In accordance with the invention, the term "pharmaceutical composition" relates to a composition for administration to a patient, preferably a human patient. The particular preferred pharmaceutical composition of this invention comprises bispecific single chain antibodies directed against and generated against context-independent CD3 epitopes. Preferably, the pharmaceutical composition comprises suitable formulations of carriers, stabilizers and/or excipients. In a preferred embodiment, the pharmaceutical composition comprises a composition for parenteral, transdermal, intraluminal, intraarterial, intrathecal and/or intranasal administration or by direct injection into tissue. It is in particular envisaged that said composition is administered to a patient via a infusion or injection. Administration of the suitable compositions may be effected by different ways, e.g., by intravenous, intraperitoneal, subcutaneous, intramuscular, topical or intradermal administration. In particular, the present invention provides for an uninterrupted administration of the suitable composition. As a non-limiting example, uninterrupted, i.e. continuous administration may be realized by a small pump system worn by the patient for metering the influx of therapeutic agent into the body of the patient. The pharmaceutical composition comprising the bispecific single chain antibodies directed against and generated against context-independent CD3 epitopes of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of these bispecific single chain antibodies directed against and generated against context-independent CD3 epitopes of this invention may be intravenuous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

The composition of the present invention, comprising in particular bispecific single chain antibodies directed against and generated against context-independent CD3 epitopes may further comprise a pharmaceutically acceptable carrier. Examples of suitable pharmaceutical carriers are well known in the art and include solutions, e.g. phosphate buffered saline solutions, water, emulsions, such as oil/water emulsions, various types of wetting agents, sterile solutions, liposomes, etc. Compositions comprising such carriers can be formulated by well known conventional methods. Formulations can comprise carbohydrates, buffer solutions, amino acids and/or surfactants. Carbohydrates may be non-reducing sugars, preferably trehalose, sucrose, octasulfate, sorbitol or xylitol. Such formulations may be used for continuous administrations which may be intravenuous or subcutaneous with and/or without pump systems. Amino acids may be charged amino acids, preferably lysine, lysine acetate, arginine, glutamate and/or histidine. Surfactants may be detergents, preferably with a molecular weight of >1.2 KD and/or a polyether, preferably with a molecular weight of >3 KD. Non-limiting examples for preferred detergents are TWEEN® 20, TWEEN® 40, TWEEN® 60, TWEEN® 80 or TWEEN® 85. Non-limiting examples for preferred polyethers are PEG 3000, PEG 3350, PEG 4000 or PEG 5000. Buffer systems used in the present invention can have a preferred pH of 5-9 and may comprise citrate, succinate, phosphate, histidine and acetate. The compositions of the present invention can be administered to the subject at a suitable dose which can be determined e.g. by dose escalating studies by administration of increasing doses of the bispecific single chain antibody molecule of the invention exhibiting cross-species specificity described herein to non-chimpanzee primates, for instance macaques. As set forth above, the bispecific single chain antibody molecule of the invention exhibiting cross-species specificity described herein can be advantageously used in identical form in preclinical testing in non-chimpanzee primates and as drug in humans. These compositions can also be administered in combination with other proteinaceous and non-proteinaceous drugs. These drugs may be administered simultaneously with the composition comprising the bispecific single chain antibody molecule of the invention as defined herein or separately before or after administration of said polypeptide in timely defined intervals and doses. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently. Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, inert gases and the like. In addition, the composition of the present invention might comprise proteinaceous carriers, like, e.g., serum albumin or immunoglobulin, preferably of human origin. It is envisaged that the composition of the invention might comprise, in addition to the bispecific single chain antibody molecule of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various cancer specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that effect the ability of a particular drug to treat a given condition, is established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc.

By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment.

"Lag time" means the time delay between the administration of the drug and its detection and measurability in blood or plasma.

"Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetik parameters of bispecific single chain antibodies exhibiting cross-species specificity, which may be determined in preclinical animal testing in non-chimpanzee primates as outlined above are also set forth e.g. in the publication by Schlereth et al. (Cancer Immunol. Immunother. 20 (2005), 1-12).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviating to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance haematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The term "effective and non-toxic dose" as used herein refers to a tolerable dose of the bispecific single chain antibody as defined herein which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

Moreover, the invention relates to a pharmaceutical composition comprising a bispecific single chain antibody molecule of this invention or produced according to the process according to the invention for the prevention, treatment or amelioration of cancer. Preferably, said pharmaceutical composition further comprises suitable formulations of carriers, stabilizers and/or excipients.

A further aspect of the invention relates to a use of a bispecific single chain antibody molecule/polypeptide as defined herein above or produced according to a process defined herein above, for the preparation of a pharmaceutical composition for the prevention, treatment or amelioration of a disease. Preferably, said disease is cancer.

In another preferred embodiment of use of the bispecific single chain antibody molecule of the invention said pharmaceutical composition is suitable to be administered in combination with an additional drug, i.e. as part of a co-therapy. In said co-therapy, an active agent may be optionally included in the same pharmaceutical composition as the bispecific single chain antibody molecule of the invention, or may be included in a separate pharmaceutical composition. In this latter case, said separate pharmaceutical composition is suitable for administration prior to, simultaneously as or following administration of said pharmaceutical composition comprising the bispecific single chain antibody molecule of the invention. The additional drug or pharmaceutical composition may be a non-proteinaceous compound or a proteinaceous compound. In the case that the additional drug is a proteinaceous compound, it is advantageous that the proteinaceous compound be capable of providing an activation signal for immune effector cells.

Preferably, said proteinaceous compound or non-proteinaceous compound may be administered simultaneously or non-simultaneously with the bispecific single chain antibody molecule of the invention, a nucleic acid molecule as defined hereinabove, a vector as defined as defined hereinabove, or a host as defined as defined hereinabove.

Another aspect of the invention relates to a method for the prevention, treatment or amelioration of a disease in a subject in the need thereof, said method comprising the step of administration of an effective amount of a pharmaceutical composition of the invention. Preferably, said disease is cancer.

In another preferred embodiment of the method of the invention said pharmaceutical composition is suitable to be administered in combination with an additional drug, i.e. as part of a co-therapy. In said co-therapy, an active agent may be optionally included in the same pharmaceutical composition as the bispecific single chain antibody molecule of the invention, or may be included in a separate pharmaceutical composition. In this latter case, said separate pharmaceutical composition is suitable for administration prior to, simultaneously as or following administration of said pharmaceutical composition comprising the bispecific single chain antibody molecule of the invention. The additional drug or pharmaceutical composition may be a non-proteinaceous compound or a proteinaceous compound. In the case that the additional drug is a proteinaceous compound, it is advantageous that the proteinaceous compound be capable of providing an activation signal for immune effector cells.

Preferably, said proteinaceous compound or non-proteinaceous compound may be administered simultaneously or non-simultaneously with the bispecific single chain antibody molecule of the invention, a nucleic acid molecule as defined hereinabove, a vector as defined as defined hereinabove, or a host as defined as defined hereinabove.

It is preferred for the above described method of the invention that said subject is a human.

In a further aspect, the invention relates to a kit comprising a bispecific single chain antibody molecule of the invention, a nucleic acid molecule of the invention, a vector of the invention, or a host of the invention.

These and other embodiments are disclosed and encompassed by the description and Examples of the present invention. Recombinant techniques and methods in immunology are described e.g. in Sambrook et al. Molecular Cloning: A Laboratory Manual; Cold Spring Harbor Laboratory Press, $3^{rd}$ edition 2001; Lefkovits; Immunology Methods Manual; The Comprehensive Sourcebook of Techniques; Academic Press, 1997; Golemis; Protein-Protein Interactions: A Molecular Cloning Manual; Cold Spring Laboratory Press, 2002. Further literature concerning any one of the antibodies, methods, uses and compounds to be employed in accordance with the present invention may be retrieved from public libraries and databases, using for example electronic devices. For example, the public database "Medline", available on the Internet, may be utilized, for example underhttp_colon_forward slash_forward slash_www.ncbi.nlm.nih.gov_forward slash_PubMed_forward slash_medline.html. Further databases and addresses such as http_colon_forward slash_forward slash_www.ncbi.nlm.nih.go_forward slash or listed at the EMBL-services homepage under http_colon_forward slash_forward slash_www.embl.de_forward slash_services_forward slash_index.html are known to the person skilled in the art and can also be obtained using, e. g., http_colon_forward slash_forward slash_www.google.com.

The figures show:

FIG. 1

Fusion of the N-terminal amino acids 1-27 of primate CD3 epsilon to a heterologous soluble protein.

FIG. 2

The figure shows the average absorption values of quadruplicate samples measured in an ELISA assay detecting the presence of a construct consisting of the N-terminal amino acids 1-27 of the mature human CD3 epsilon chain fused to the hinge and Fc gamma portion of human IgG1 and a C-terminal 6 Histidine tag in a supernatant of transiently transfected 293 cells. The first column labeled "27 aa huCD3E" shows the average absorption value for the construct, the second column labeled "irrel. SN" shows the average value for a supernatant of 293 cells transfected with an irrelevant construct as negative control. The comparison of the values obtained for the construct with the values obtained for the negative control clearly demonstrates the presence of the recombinant construct.

FIG. 3

The figure shows the average absorption values of quadruplicate samples measured in an ELISA assay detecting the binding of the cross species specific anti-CD3 binding molecules in form of crude preparations of periplasmatically expressed single-chain antibodies to a construct comprising the N-terminal 1-27 amino acids of the mature human CD3 epsilon chain fused to the hinge and Fc gamma portion of human IgG1 and a C-terminal His6 tag. The columns show from left to right the average absorption values for the specificities designated as A2J HLP, I2C HLP E2M HLP, F70 HLP, G4H HLP, H2C HLP, E1L HLP, F12Q HLP, F6A HLP and H1E HLP. The rightmost column labelled "neg. contr." shows the average absorption value for the single-chain preparation of a murine anti-human CD3 antibody as negative control. The comparison of the values obtained for the anti-CD3 specificities with the values obtained for the negative control clearly demonstrates the strong binding of the anti-CD3 specificities to the N-terminal 1-27 amino acids of the mature human CD3 epsilon chain.

FIG. 4

Fusion of the N-terminal amino acids 1-27 of primate CD3 epsilon to a heterologous membrane bound protein.

FIG. 5

Histogram overlays of different transfectants tested in a FACS assay detecting the presence of recombinant transmembrane fusion proteins consisting of cynomolgus EpCAM and the N-terminal 1-27 amino acids of the human, marmoset, tamarin, squirrel monkey and domestic swine CD3 epsilon chain respectively. The histogram overlays from left to right and top to bottom show the results for the transfectants expressing the constructs comprising the human 27 mer, marmoset 27 mer, tamarin 27 mer, squirrel monkey 27 mer and swine 27 mer respectively. In the individual overlays the thin line represents a sample incubated with PBS with 2% FCS instead of anti-Flag® M2 antibody as negative control and the bold line shows a sample incubated with the anti-Flag® M2 antibody. For each construct the overlay of the histograms shows binding of the anti-Flag® M2 antibody to the transfectants, which clearly demonstrates the expression of the recombinant constructs on the transfectants.

FIGS. 6A-6E

Histogram overlays of different transfectants tested in a FACS assay detecting the binding of the cross-species specific anti-CD3 binding molecules in form of crude preparations of periplasmatically expressed single-chain antibodies to the N-terminal amino acids 1-27 of the human, marmoset, tamarin and squirrel monkey CD3 epsilon chain respectively fused to cynomolgus EpCAM.

FIG. 6A:

The histogram overlays from left to right and top to bottom show the results for the transfectants expressing the 1-27 CD3-EpCAM comprising the human 27 mer tested with the CD3 specific binding molecules designated H2C HLP, F12Q HLP, E2M HLP and G4H HLP respectively.

FIG. 6B:

The histogram overlays from left to right and top to bottom show the results for the transfectants expressing the 1-27 CD3-EpCAM comprising the marmoset 27 mer tested with the CD3 specific binding molecules designated H2C HLP, F12Q HLP, E2M HLP and G4H HLP respectively.

FIG. 6C:

The histogram overlays from left to right and top to bottom show the results for the transfectants expressing the 1-27 CD3-EpCAM comprising the tamarin 27 mer tested with the CD3 specific binding molecules designated H2C HLP, F12Q HLP, E2M HLP and G4H HLP respectively.

FIG. 6D:

The histogram overlays from left to right and top to bottom show the results for the transfectants expressing the 1-27 CD3-EpCAM comprising the squirrel monkey 27 mer tested with the CD3 specific binding molecules designated H2C HLP, F12Q HLP, E2M HLP and G4H HLP respectively.

FIG. 6E:

The histogram overlays from left to right and top to bottom show the results for the transfectants expressing the 1-27 CD3-EpCAM comprising the swine 27 mer tested with the CD3 specific binding molecules designated H2C HLP, F12Q HLP, E2M HLP and G4H HLP respectively.

In the individual overlays the thin line represents a sample incubated with a single-chain preparation of a murine anti-human CD3-antibody as negative control and the bold line shows a sample incubated with the respective anti-CD3 binding molecules indicated. Considering the lack of binding to the swine 27 mer transfectants and the expression levels of the constructs shown in FIG. 5 the overlays of the histograms show specific and strong binding of the tested anti-CD3 specificities of the fully cross-species specific human bispecific single chain antibodies to cells expressing the recombinant transmembrane fusion proteins comprising the N-terminal amino acids 1-27 of the human, marmoset, tamarin and squirrel monkey CD3 epsilon chain respectively fused to cynomolgus EpCAM and show therefore multi primate cross-species specificity of the anti-CD3 binding molecules.

FIG. 7

FACS assay for detection of human CD3 epsilon on transfected murine EL4 T cells. Graphical analysis shows an overlay of histograms. The bold line shows transfected cells incubated with the anti-human CD3 antibody UCHT-1. The thin line represents cells incubated with a mouse IgG1 isotype control. Binding of the anti CD3 antibody UCHT1 clearly shows expression of the human CD3 epsilon chain on the cell surface of transfected murine EL4 T cells.

FIGS. 8A-8C

Binding of cross-species specific anti CD3 antibodies to alanine-mutants in an alanine scanning experiment. In the individual Figures the columns show from left to right the calculated binding values in arbitrary units in logarithmic scale for the wild-type transfectant (WT) and for all alanine-mutants from the position 1 to 27. The binding values are calculated using the following formula:

$$\text{value\_Sample}(x, y) = \frac{\text{Sample}(x, y) - \text{neg\_Contr.}(x)}{(UCHT-1(x) - \text{neg\_Contr.}(x)) *} \frac{WT(y) - \text{neg\_Contr.(wt.)}}{UCHT-1(\text{wt}) - \text{neg\_Contr.(wt)}}$$

In this equation value_Sample means the value in arbitrary units of binding depicting the degree of binding of a specific anti-CD3 antibody to a specific alanine-mutant as shown in the Figure, Sample means the geometric mean fluorescence value obtained for a specific anti-CD3 antibody assayed on a specific alanine-scanning transfectant, neg_Contr. means the geometric mean fluorescence value obtained for the negative control assayed on a specific alanine-mutant, UCHT-1 means the geometric mean fluorescence value obtained for the UCHT-1 antibody assayed on a specific alanine-mutant, WT means the geometric mean fluorescence value obtained for a specific anti-CD3 antibody assayed on the wild-type transfectant, x specifies the respective transfectant, y specifies the respective anti-CD3 antibody and wt specifies that the respective transfectant is the wild-type. Individual alanine-mutant positions are labelled with the single letter code of the wild-type amino acid and the number of the position.

FIG. 8A:

The figure shows the results for cross-species specific anti CD3 antibody A2J HLP expressed as chimeric IgG molecule. Reduced binding activity is observed for mutations to alanine at position 4 (asparagine), at position 23 (threonine) and at position 25 (isoleucine). Complete loss of binding is observed for mutations to alanine at position 1 (glutamine), at position 2 (aspartate), at position 3 (glycine) and at position 5 (glutamate).

FIG. 8B:

The figure shows the results for cross-species specific anti CD3 antibody E2M HLP, expressed as chimeric IgG molecule. Reduced binding activity is observed for mutations to alanine at position 4 (asparagine), at position 23 (threonine)

and at position 25 (isoleucine). Complete loss of binding is observed for mutations to alanine at position 1 (glutamine), at position 2 (aspartate), at position 3 (glycine) and at position 5 (glutamate).

FIG. 8C:

The figure shows the results for cross-species specific anti CD3 antibody H2C HLP, expressed as chimeric IgG molecule. Reduced binding activity is observed for mutations to alanine at position 4 (asparagine). Complete loss of binding is observed for mutations to alanine glutamine at position 1 (glutamine), at position 2 (aspartate), at position 3 (glycine) and at position 5 (glutamate).

FIG. 8D:

shows the results for cross-species specific anti CD3 antibody F12Q HLP, tested as periplasmatically expressed single-chain antibody. Complete loss of binding is observed for mutations to alanine at position 1 (glutamine), at position 2 (aspartate), at position 3 (glycine) and at position 5 (glutamate).

FIG. 9

FACS assay detecting the binding of the cross-species specific anti-CD3 binding molecule H2C HLP to human CD3 with and without N-terminal His6 tag.

Histogram overlays are performed of the EL4 cell line transfected with wild-type human CD3 epsilon chain (left histogram) or the human CD3 epsilon chain with N-terminal His6 tag (right histogram) tested in a FACS assay detecting the binding of cross-species specific binding molecule H2C HLP. Samples are incubated with an appropriate isotype control as negative control (thin line), anti-human CD3 antibody UCHT-1 as positive control (dotted line) and cross-species specific anti-CD3 antibody H2C HLP in form of a chimeric IgG molecule (bold line).

Histogram overlays show comparable binding of the UCHT-1 antibody to both transfectants as compared to the isotype control demonstrating expression of both recombinant constructs. Histogram overlays also show binding of the anti-CD3 binding molecule H2C HLP only to the wild-type human CD3 epsilon chain but not to the His6-human CD3 epsilon chain. These results demonstrate that a free N-terminus is essential for binding of the cross-species specific anti-CD3 binding molecule H2C HLP.

FIG. 10

FACS binding analysis of designated cross-species specific bispecific single chain constructs to CHO cells transfected with the human MCSP D3, human CD3+ T cell line HPB-ALL, CHO cells transfected with cynomolgus MCSP D3 and a macaque T cell line 4119 LnPx. The FACS staining is performed as described in Example 10.

The thick line represents cells incubated with 2 μg/ml purified protein that are subsequently incubated with the anti-his antibody and the PE labeled detection antibody. The thin histogram line reflects the negative control: cells only incubated with the anti-his antibody and the detection antibody.

FIG. 11

FACS binding analysis of designated cross-species specific bispecific single chain constructs CHO cells transfected with the human MCSP D3, human CD3+ T cell line HPB-ALL, CHO cells transfected with cynomolgus MCSP D3 and a macaque T cell line 4119 LnPx. The FACS staining is performed as described in Example 10. The thick line represents cells incubated with 2 μg/ml purified protein that are subsequently incubated with the anti-his antibody and the PE labeled detection antibody. The thin histogram line reflects the negative control: cells only incubated with the anti-his antibody and the detection antibody.

FIG. 12

FACS binding analysis of designated cross-species specific bispecific single chain constructs CHO cells transfected with the human MCSP D3, human CD3+ T cell line HPB-ALL, CHO cells transfected with cynomolgus MCSP D3 and a macaque T cell line 4119 LnPx. The FACS staining is performed as described in Example 10. The thick line represents cells incubated with 2 μg/ml purified monomeric protein that are subsequently incubated with the anti-his antibody and the PE labeled detection antibody. The thin histogram line reflects the negative control: cells only incubated with the anti-his antibody and the detection antibody.

FIG. 13

Cytotoxicity activity induced by designated cross-species specific MCSP specific single chain constructs redirected to indicated target cell lines. A) Stimulated CD4−/CD56− human PBMCs are used as effector cells, CHO cells transfected with human MCSP D3 as target cells. B) The macaque T cell line 4119 LnPx are used as effector cells, CHO cells transfected with cynomolgus MCSP D3 as target cells. The assay is performed as described in Example 11.

FIG. 14

Cytotoxicity activity induced by designated cross-species specific MCSP specific single chain constructs redirected to indicated target cell lines. A) and B) The macaque T cell line 4119 LnPx are used as effector cells, CHO cells transfected with cynomolgus MCSP D3 as target cells. The assay is performed as described in Example 11.

FIG. 15

Cytotoxicity activity induced by designated cross-species specific MCSP specific single chain constructs redirected to indicated target cell lines. A) and B) Stimulated CD4−/CD56− human PBMCs are used as effector cells, CHO cells transfected with human MCSP D3 as target cells. The assay is performed as described in Example 11.

FIG. 16

Cytotoxicity activity induced by designated cross-species specific MCSP specific single chain constructs redirected to indicated target cell lines. A) Stimulated CD4−/CD56− human PBMCs are used as effector cells, CHO cells transfected with human MCSP D3 as target cells. B) The macaque T cell line 4119 LnPx are used as effector cells, CHO cells transfected with cynomolgus MCSP D3 as target cells. The assay is performed as described in Example 11.

FIG. 17

Cytotoxicity activity induced by designated cross-species specific MCSP specific single chain constructs redirected to indicated target cell lines. A) Stimulated CD4−/CD56− human PBMCs are used as effector cells, CHO cells transfected with human MCSP D3 as target cells. B) The macaque T cell line 4119 LnPx are used as effector cells, CHO cells transfected with cynomolgus MCSP D3 as target cells. The assay is performed as described in Example 11.

FIGS. 18A-18C

Figure 18A:
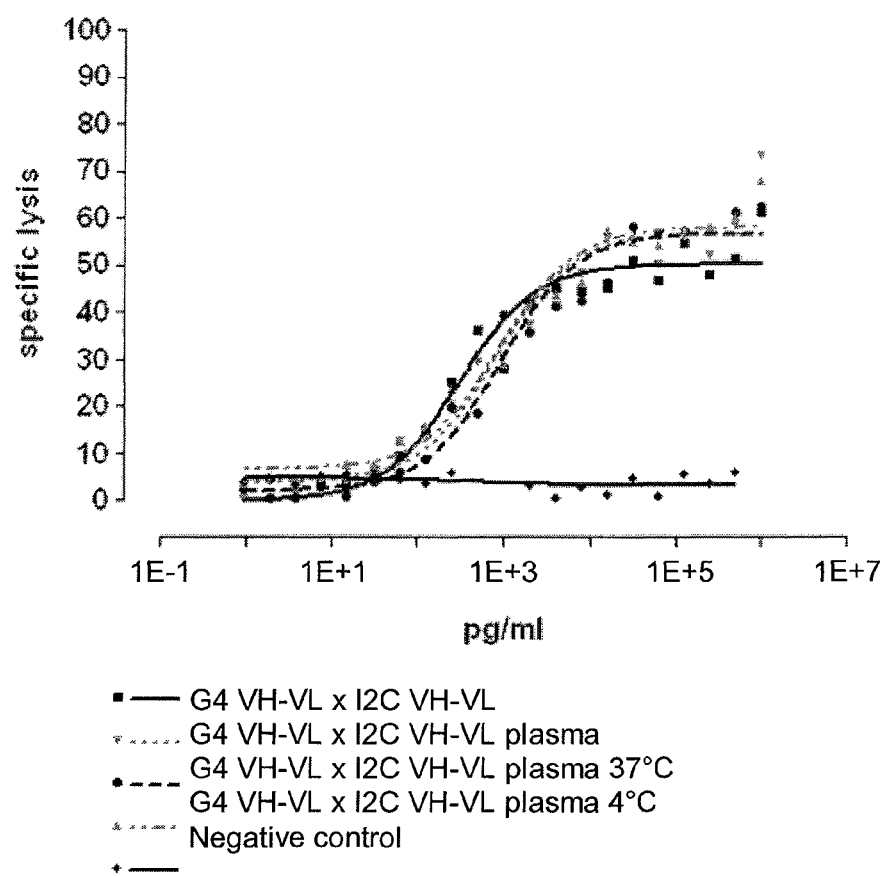

Plasma stability of MCSP and CD3 cross-species specific bispecific single chain antibodies tested by the measurement of cytotoxicity activity induced by samples of the designated single chain constructs (G4×I2C (FIG. 18A); G4×H2C (FIG. 18B); and G4×F12Q (FIG. 18C)) incubated with 50% human plasma at 37° C. and 4° C. for 24 hours respectively or with addition of 50% human plasma immediately prior to cytotoxicity testing or without addition of plasma. CHO cells transfected with human MCSP are used as target cell line and stimulated CD4−/CD56− human PBMCs are used as effector cells. The assay is performed as described in Example 12.

FIGS. 19A-19F

Figure 19A:
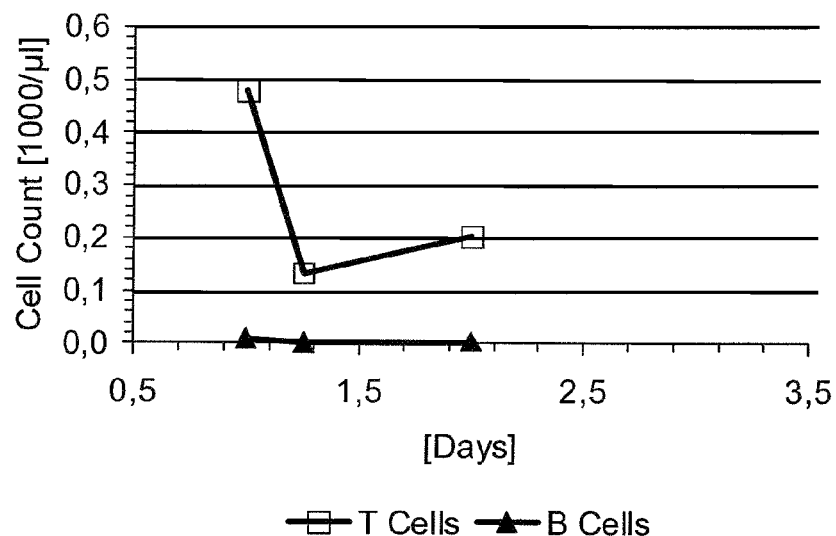
Figure 19B:
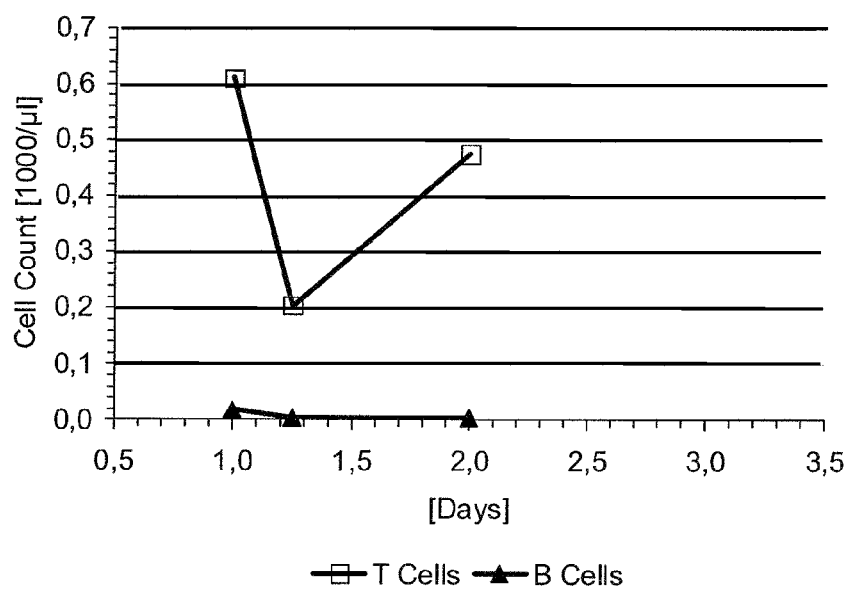
Figure 19C:
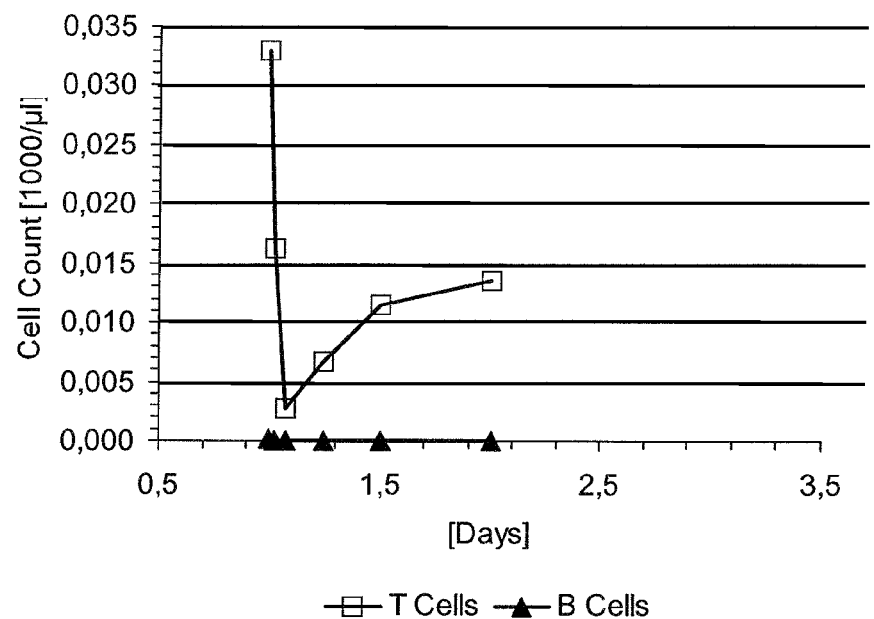
Figure 19D:
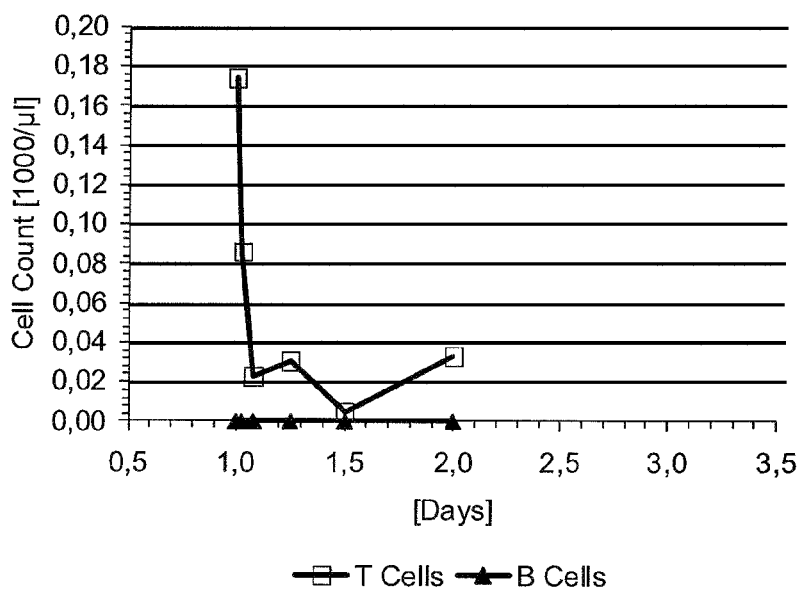
Figure 19E:
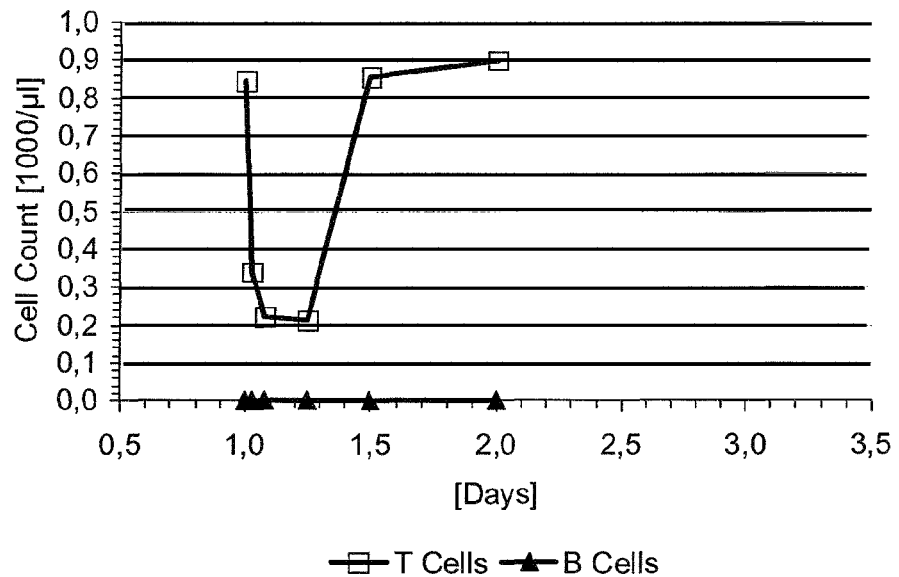
Figure 19F:
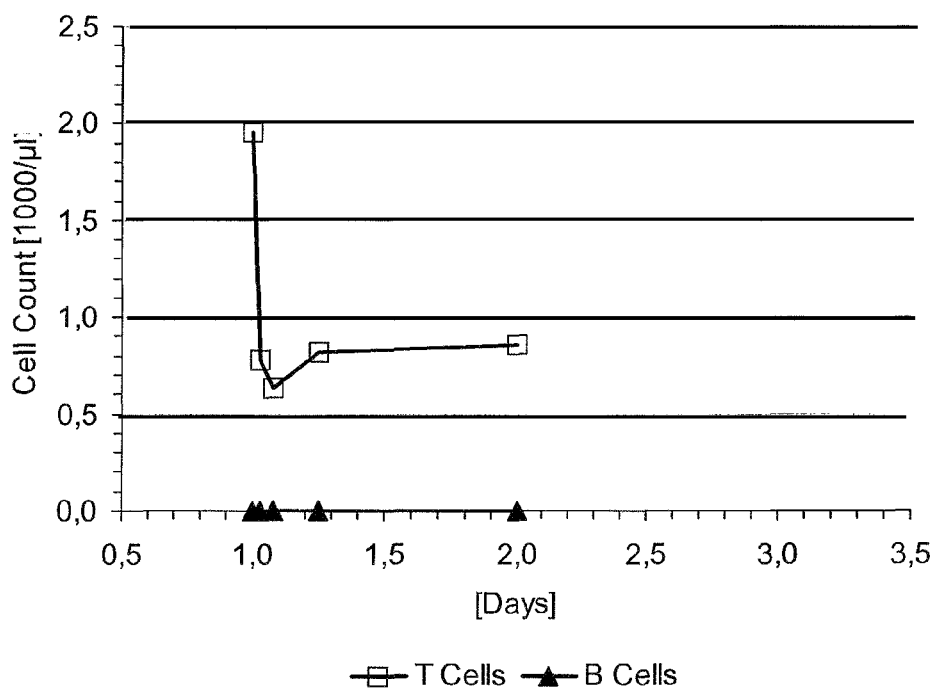

Initial drop and recovery (i.e. redistribution) of absolute T cell counts (open squares), in peripheral blood of B-NHL patients (patent numbers 1 (FIG. 19A), 7 (FIG. 19B), 23 (FIG. 19C), 30 (FIG. 19D), 31 (FIG. 19E), and 33 (FIG. 19F) of Table 4), who had essentially no circulating CD19-positive target B cells (filled triangles), during the starting phase of intravenous infusion with the CD3 binding molecule CD19×CD3 recognizing a conventional context dependent CD3 epitope. Absolute cell counts are given in 1000 cells per microliter blood. The first data point shows baseline counts immediately prior to the start of infusion. The CD19×CD3 dose is given in parentheses beside the patient number.

FIGS. 20A-20B

FIG. 20A

Repeated T cell redistribution (open squares) in B-NHL patient #19 (Table 4) who had no circulating CD19-positive target B cells (filled triangles) and developed CNS symptoms under continuous intravenous infusion with CD19×CD3 at a starting dose of 5 µg/m$^2$/24 h for one day followed by a sudden dose increase to 15 µg/m$^2$/24 h. Absolute cell counts are given in 1000 cells per microliter blood. The first data point shows baseline counts immediately prior to the start of infusion. After recovery of circulating T cells from the first episode of redistribution triggered by the treatment start at 5 µg/m$^2$/24 h the stepwise dose increase from 5 to 15 µg/m$^2$/24 h triggered a second episode of T cell redistribution that was associated with the development of CNS symptoms dominated by confusion and disorientation.

FIG. 20B

Repeated T cell redistribution in a B-NHL patient, who developed CNS symptoms under repeated intravenous bolus infusion with CD19×CD3 at 1.5 µg/m$^2$. Absolute cell counts are given in 1000 cells per microliter blood. The infusion time for each bolus administration was 2 to 4 hours. Vertical arrows indicate the start of bolus infusions. Data points at the beginning of each bolus administration show the T cell counts immediately prior to start of bolus infusion. Each bolus infusion triggered an episode of T cell redistribution followed by recovery of the T cell counts prior to the next bolus infusion. Finally the third episode of T cell redistribution was associated with the development of CNS symptoms in this patient.

FIG. 21

Complex T cell redistribution pattern (open squares) in B-NHL patient #20 (Table 4) without circulating CD19-positive target B cells (filled triangles), during ramp initiation of the CD19×CD3 infusion i.e. even gradual increase of flow-rate from almost zero to 15 µg/m$^2$/24 h during the first 24 hours of treatment. Absolute cell counts are given in 1000 cells per microliter blood. The first data point shows baseline counts immediately prior to the start of infusion. The CD19×CD3 dose is given in parentheses beside the patient number. T cells reappearing in the circulating blood after the initial redistribution triggered by the first exposure to CD19×CD3 are partially induced to redisappear from circulating blood again by still increasing levels of CD19×CD3 during the ramp phase.

FIG. 22

T and B cell counts during treatment with CD19×CD3 of B-NHL patient #13 (Table 4) who had a significant number of circulating CD19-positive target B (lymphoma) cells (filled triangles). Absolute cell counts are given in 1000 cells per microliter blood. The first data point shows baseline counts immediately prior to the start of infusion. The CD19×CD3 dose is given in parentheses beside the patient number. T cells (open squares) disappear completely from the circulation upon start of CD19×CD3 infusion and do not reappear until the circulating CD19-positive B (lymphoma) cells (filled triangles) are depleted from the peripheral blood.

FIG. 23

Repeated T cell redistribution (open squares) in B-NHL patient #24 (Table 4), who had essentially no circulating CD19-positive target B cells (filled triangles) and developed CNS symptoms upon initiation of CD19×CD3 infusion without additional HSA as required for stabilisation of the drug (upper panel). After first recovery of circulating T cells from initial redistribution the uneven drug flow due to the lack of stabilizing HSA triggered a second episode of T cell redistribution that was associated with the development of CNS symptoms dominated by confusion and disorientation. When the same patient was restarted correctly with CD19×CD3 solution containing additional HSA for drug stabilisation, no repeated T cell redistribution was observed (lower panel) and the patient did not again develop any CNS symptoms. Absolute cell counts are given in 1000 cells per microliter blood. The first data point shows baseline counts immediately prior to the start of infusion. The CD19×CD3 dose is given in parentheses beside the patient number.

FIG. 24

Model of T cell adhesion to endothelial cells induced by monovalent binding to context dependent CD3 epitopes. Monovalent interaction of a conventional CD3 binding molecule to its context dependent epitope on CD3 epsilon can lead to an allosteric change in the conformation of CD3 followed by the recruitment of Nck2 to the cytoplasmic domain of CD3 epsilon (Gil et al. (2002) Cell 109: 901). As Nck2 is directly linked to integrins via PINCH and ILK (Legate et al. (2006) Nat Rev Mol Cell Biol 7: 20), recruitment of Nck2 to the cytoplasmic domain of CD3 epsilon following an allosteric change in the conformation of CD3 through binding of a conventional CD3 binding molecule (like the CD19×CD3 of example 13) to its context dependent epitope on CD3 epsilon, can increase the adhesiveness of T cells to endothelial cells by transiently switching integrins on the T cell surface into their more adhesive isoform via inside-out-signalling.

FIG. 25

Cytotoxic activity of CD33-AF5 VH-VL×I2C VH-VL test material used for the in vivo study in cynomolgus monkeys as described in Example 14. Specific lysis of CD33-positive target cells was determined in a standard $^{51}$Chromium release assay at increasing concentrations of CD33-AF5 VH-VL×I2C VH-VL. Assay duration was 18 hours. The macaque T cell line 4119 LnPx was used as source of effector cells. CHO cells transfected with cynomolgus CD33 served as target cells. Effector- to target cell ratio (E:T-ratio) was 10:1. The concentration of CD33-AF5 VH-VL×I2C VH-VL required for half-maximal target cell lysis (EC50) was calculated from the dose response curve with a value of 2.7 ng/ml.

FIGS. 26A-26C

FIG. 26A

Dose- and time-dependent depletion of CD33-positive monocytes from the peripheral blood of cynomolgus monkeys through intravenous continuous infusion of CD33-AF5 VH-VL×I2C VH-VL as described in Example 14. The percentage relative to baseline (i.e. 100%) of absolute circulating CD33-positive monocyte counts after the duration of treatment as indicated above the columns is shown for each of two cynomolgus monkeys per dose level. The dose level (i.e. infusion flow-rate) is indicated below the columns. No depletion of circulating CD33-positive monocytes was observed in animals 1 and 2 treated for 7 days at a dose of 30 µg/m²/24 h. In animals 3 and 4 treated for 7 days at a dose of 60 µg/m²/24 h circulating CD33-positive monocyte counts were reduced to 68% and 40% of baseline, respectively. At 240 µg/m²/24 h circulating CD33-positive monocytes were almost completely depleted from the peripheral blood after 3 days of treatment (animals 5 and 6). At 1000 µg/m²/24 h depletion of circulating CD33-positive monocytes from the peripheral blood was completed already after 1 day of treatment (animals 7 and 8).

FIGS. 26B-C

Course of T cell and CD33-monocyte counts in peripheral blood of two cynomolgus monkeys during continuous infusion of CD33-AF5 VH-VL×I2C VH-VL for 14 days at 120 µg/m²/24 h. Absolute cell counts are given in 1000 cells per microliter blood. The first data point shows baseline counts immediately prior to the start of infusion. After initial mobilisation of CD33-monocytes during the first 12 hours upon start of infusion CD33-monocytes in peripheral blood (filled triangles) are depleted by two thirds (animal 10 (FIG. 26C)) and 50% (animal 9 (FIG. 26B)) relative to the respective baseline counts during the further course of infusion. Circulating T cell counts (open squares) show a limited initial drop followed by recovery still during the presence of circulating CD33-positive monocytic target cells.

FIG. 27

Cytotoxic activity of MCSP-G4 VH-VL×I2C VH-VL test material used for the in vivo study in cynomolgus monkeys as described in Example 15. Specific lysis of MCSP-positive target cells was determined in a standard $^{51}$Chromium release assay at increasing concentrations of MCSP-G4 VH-VL×I2C VH-VL. Assay duration was 18 hours. The macaque T cell line 4119 LnPx was used as source of effector cells. CHO cells transfected with cynomolgus MCSP served as target cells. Effector- to target cell ratio (E:T-ratio) was 10:1. The concentration of MCSP-G4 VH-VL×I2C VH-VL required for half-maximal target cell lysis (EC50) was calculated from the dose response curve with a value of 1.9 ng/ml.

FIGS. 28A-28B

Absence of initial episodes of drop and subsequent recovery of absolute T cell counts (i.e. redistribution) in peripheral blood of cynomolgus monkeys during the starting phase of intravenous infusion with the CD3 binding molecule MCSP-G4 VH-VL×I2C VH-VL recognizing an essentially context independent CD3 epitope. Absolute cell counts are given in 1000 cells per microliter blood. The first data point shows baseline counts immediately prior to the start of infusion. The MCSP-G4 VH-VL×I2C VH-VL dose is given in parentheses beside the animal number. In the known absence of MCSP-positive target cells from the circulating blood of cynomolgus monkeys there is no induction of T cell redistribution (i.e. an initial episode of drop and subsequent recovery of absolute T cell counts) through target cell mediated crosslinking of CD3. Moreover, induction of T cell redistribution (i.e. an initial episode of drop and subsequent recovery of absolute T cell counts) through a signal, which the T cells may receive through exclusive interaction with a CD3 binding site only, can be avoided by the use of CD3 binding molecules like MCSP-G4 VH-VL×I2C VH-VL recognizing an essentially context independent CD3 epitope.

FIGS. 29A-29L

FACS binding analysis of designated cross-species specific bispecific constructs to CHO cells transfected with human CD33, the human CD3+ T cell line HPB-ALL, CHO cells transfected with macaque CD33 and macaque PBMC respectively. The FACS staining is performed as described in Example 16.4. The bold lines represent cells incubated with 5 µg/ml purified bispecific single chain construct or cell culture supernatant of transfected cells expressing the cross-species specific bispecific antibody constructs. The filled histograms reflect the negative controls. Supernatant of untransfected CHO cells was used as negative control. For each cross-species specific bispecific single chain construct the overlay of the histograms shows specific binding of the construct to human and macaque CD33 and human and macaque CD3.

FIGS. 30A-30H

The diagrams show results of chromium release assays measuring cytotoxic activity induced by designated cross-species specific CD33 specific single chain constructs redirected to the indicated target cell lines. Effector cells were also used as indicated. The assays are performed as described in Example 16.5. The diagrams clearly demonstrate for each construct the potent recruitment of cytotoxic activity of human and macaque effector cells against human and macaque CD33 transfected CHO cells, respectively.

FIG. 31

SDS PAGE gel and Western blot monitoring the purification of the cross-species specific bispecific single chain molecule designated E292F3 HL×I2C HL. Samples from the eluate, the cell culture supernatant (SN) and the flow through of the column (FT) were analyzed as indicated. A protein marker (M) was applied as size reference. A strong protein band with a molecular weight between 50 and 60 kDa in the SDS PAGE gel demonstrates the efficient purification of the cross-species specific bispecific single chain molecule to a very high degree of purity with the one-step purification method described in Example 17.2. The Western blot detecting the histidine$_6$ tag confirms the identity of the protein band in the eluate as the cross-species specific bispecific single chain molecule. The faint signal for the flow through sample in this sensitive detection method further shows the nearly complete capture of bispecific single chain molecules by the purification method.

FIG. 32

SDS PAGE gel and Western blot monitoring the purification of the cross-species specific bispecific single chain molecule designated V207C12 HL×H2C HL. Samples from the eluate, the cell culture supernatant (SN) and the flow through of the column (FT) were analyzed as indicated. A protein marker (M) was applied as size reference. A strong protein band with a molecular weight between 50 and 60 kDa in the SDS PAGE gel demonstrates the efficient purification of the cross-species specific bispecific single chain molecule to a very high degree of purity with the one-step purification method described in Example 17.2. The Western blot detecting the histidine$_6$ tag confirms the identity of the protein band in the eluate as the cross-species specific bispecific single chain molecule. The faint signal for the flow through sample in this sensitive detection method further shows the nearly complete capture of bispecific single chain molecules by the purification method.

FIG. 33

SDS PAGE gel and Western blot monitoring the purification of the cross-species specific bispecific single chain molecule designated AF5HL×F12QHL. Samples from the eluate, the cell culture supernatant (SN) and the flow through of the column (FT) were analyzed as indicated. A protein marker (M) was applied as size reference. A strong protein band with a molecular weight between 50 and 60 kDa in the SDS PAGE gel demonstrates the efficient purification of the cross-species specific bispecific single chain molecule to a very high degree of purity with the one-step purification method described in Example 17.2. The Western blot detecting the histidine$_6$ tag confirms the identity of the protein band in the eluate as the cross-species specific bispecific single chain molecule. The signal in the flow through sample in this sensitive detection method is explained by saturation of the affinity column due to the high concentration of bispecific single chain molecules in the supernatant.

FIG. 34

Standard curve of AF5HL×I2CHL in 50% macaque monkey serum. The upper diagram shows the standard curve generated for the assay as described in Example 18.2.

The lower diagram shows results for quality control samples of AF5HL×I2CHL in 50% macaque monkey serum. The recovery rates are above 90% for the high and mid QC sample and above 80% for the low QC sample.

Thus the assay allows for detection of AF5HL×I2CHL in serum samples in the range from 10 ng/ml to 200 ng/ml (before dilution).

FIG. 35

Standard curve of MCSP-G4 HL×I2C HL in 50% macaque monkey serum. The upper diagram shows the standard curve generated for the assay as described in Example 18.2.

The lower diagram shows results for quality control samples of MCSP-G4 HL×I2C HL in 50% macaque monkey serum. The recovery rates are above 98% for the high and mid QC sample and above 85% for the low QC sample.

Thus the assay allows for detection of MCSP-G4 HL×I2C HL in serum samples in the range from 10 ng/ml to 200 ng/ml (before dilution).

FIG. 36

FACS binding analysis of an anti-Flag® antibody to CHO cells transfected with the 1-27 N-terminal amino acids of CD3 epsilon of the designated species fused to cynomolgus EpCAM. The FACS staining was performed as described in Example 19.1. The bold lines represent cells incubated with the anti-Flag® antibody. The filled histograms reflect the negative controls. PBS with 2% FCS was used as negative control. The histograms show strong and comparable binding of the anti-Flag® antibody to all transfectants indicating strong and equal expression of the transfected constructs.

FIG. 37

FACS binding analysis of the I2C IgG1 construct to CHO cells expressing the 1-27 N-terminal amino acids of CD3 epsilon of the designated species fused to cynomolgus EpCAM. The FACS staining is performed as described in Example 19.3. The bold lines represent cells incubated with 50 µl cell culture supernatant of cells expressing the I2C IgG1 construct. The filled histograms reflect the negative control. Cells expressing the 1-27 N-terminal amino acids of CD3 epsilon of swine fused to cynomolgus EpCAM were used as negative control. In comparison with the negative control the histograms clearly demonstrate binding of the I2C IgG1 construct to 1-27 N-terminal amino acids of CD3 epsilon of human, marmoset, tamarin and squirrel monkey.

FIG. 38

FACS binding analysis of the I2C IgG1 construct as described in Example 19.2 to human CD3 with and without N-terminal His6 tag as described in Examples 6.1 and 5.1 respectively. The bold lines represent cells incubated with the anti-human CD3 antibody UCHT-1, the penta-His antibody (Qiagen) and cell culture supernatant of cells expressing the I2C IgG1 construct respectively as indicated. The filled histograms reflect cells incubated with an irrelevant murine IgG1 antibody as negative control.

The upper two histogram overlays show comparable binding of the UCHT-1 antibody to both transfectants as compared to the isotype control demonstrating expression of both recombinant constructs. The centre histogram overlays show binding of the penta his antibody to the cells expressing the His6-human CD3 epsilon chain (His6-CD3) but not to the cells expressing the wild-type CD3 epsilon chain (WT-CD3). The lower Histogram overlays show binding of the I2C IgG1 construct to the wild-type human CD3 epsilon chain but not to the His6-human CD3 epsilon chain. These results demonstrate that a free N-terminus is essential for binding of the cross-species specific anti-CD3 binding molecule I2C to the CD3 epsilon chain.

FIGS. 39A-39L

FACS binding analysis of designated cross-species specific bispecific single chain constructs to CHO cells transfected with human MCSP D3, the human CD3+ T cell line HPB-ALL, CHO cells transfected with macaque MCSP D3 and the macaque T cell line 4119 LnPx respectively. The FACS staining was performed as described in Example 10. The bold lines represents cells incubated with 2 µg/ml purified bispecific single chain construct or cell supernatant containing the bispecific single chain construct respectively. The filled histograms reflect the negative controls. Supernatant of untransfected CHO cells was used as negative control for binding to the T cell lines. A single chain construct with irrelevant target specificity was used as negative control for binding to the MCSP D3 transfected CHO cells. For each cross-species specific bispecific single chain construct the overlay of the histograms shows specific binding of the construct to human and macaque MCSP D3 and human and macaque CD3.

FIGS. 40A-40D

Cytotoxic activity induced by designated cross-species specific MCSP D3 specific single chain constructs redirected to the indicated target cell lines. Effector cells and effector to target ratio were also used as indicated. The assay is performed as described in Example 11. The diagrams clearly demonstrate potent cross-species specific recruitment of cytotoxic activity by each construct.

FIGS. 41A-41B

FACS binding analysis of designated cross-species specific bispecific single chain constructs to CHO cells transfected with human CD33, the human CD3+ T cell line HPB-ALL, CHO cells transfected with macaque CD33 and macaque PBMC respectively. The FACS staining was performed as described in Example 21.2. The bold lines represent cells incubated with cell culture supernatant of transfected cells expressing the cross-species specific bispecific antibody constructs. The filled histograms reflect the negative controls. Supernatant of untransfected CHO cells was used as negative control. For each cross-species specific bispecific single chain construct the overlay of the histograms shows specific binding of the construct to human and macaque CD33 and human and macaque CD3.

FIG. 42

The diagrams show results of chromium release assays measuring cytotoxic activity induced by designated cross-species specific CD33 specific single chain constructs redirected to the indicated target cell lines. Effector cells were also used as indicated. The assays are performed as described in Example 21.3. The diagrams clearly demonstrate for each construct the potent recruitment of cytotoxic activity of human and macaque effector cells against human and macaque CD33 transfected CHO cells, respectively.

FIG. 43

T cell redistribution in a chimpanzee under weekly intravenous bolus infusion with PBS/5% HSA and PBS/5% HSA plus single-chain EpCAM/CD3-bispecific antibody construct at doses of 1.6, 2.0, 3.0 and 4.5 µg/kg. The infusion time for each bolus administration was 2 hours. Vertical arrows indicate the start of bolus infusions. Data points at the beginning of each bolus administration show the T cell counts immediately prior to start of bolus infusion. Each bolus infusion of the single-chain EpCAM/CD3-bispecific antibody construct, which recognizes a conventional context dependent CD3 epitope, triggered an episode of T cell redistribution followed by recovery of T cells to baseline values prior to the next bolus infusion.

FIG. 44

CD3 specific ELISA analysis of periplasmic preparations containing Flag tagged scFv protein fragments from selected clones. Periplasmic preparations of soluble scFv protein fragments were added to wells of an ELISA plate, which had been coated with soluble human CD3 epsilon (aa 1-27)-Fc fusion protein and had been additionally blocked with PBS 3% BSA. Detection was performed by a monoclonal anti Flag-Biotin-labeled antibody followed by peroxidase-conjugated Streptavidin. The ELISA was developed by an ABTS substrate solution. The OD values (y axis) were measured at 405 nm by an ELISA reader. Clone names are presented on the x axis.

FIG. 45

ELISA analysis of periplasmic preparations containing Flag tagged scFv protein fragments from selected clones. The same periplasmic preparations of soluble scFv protein fragments as in FIG. 44 were added to wells of an ELISA plate which had not been coated with human CD3 epsilon (aa 1-27)-Fc fusion protein but with huIgG1 (Sigma) and blocked with 3% BSA in PBS.

Detection was performed by a monoclonal anti Flag-Biotin-labeled antibody followed by peroxidase-conjugated Streptavidin. The ELISA was developed by an ABTS substrate solution. The OD values (y axis) were measured at 405 nm by an ELISA reader. Clone names are presented on the x axis.

FIG. 46/1

FACS binding analysis of designated cross-species specific single domain bispecific single chain constructs to CHO cells transfected with human EGFR, human CD3+ T cell line HPB-ALL, CHO cells transfected with macaque EGFR and a macaque T cell line 4119 LnPx. The FACS staining was performed as described in Example 24.5. The thick line represents cells incubated with cell culture supernatant containing the construct to be tested that were subsequently incubated with the anti-His antibody and the PE labeled detection antibody. The thin histogram line reflects the negative control: cells only incubated with the anti-his antibody and the detection antibody.

FIG. 46/2

FACS binding analysis of designated cross-species specific single domain bispecific single chain constructs to CHO cells transfected with the human EGFR, human CD3+ T cell line HPB-ALL, CHO cells transfected with macaque EGFR and a macaque T cell line 4119 LnPx. The FACS staining was performed as described in Example 24. 5. The thick line represents cells incubated with cell culture supernatant containing the construct to be tested that were subsequently incubated with the anti-His antibody and the PE labeled detection antibody. The thin histogram line reflects the negative control: cells only incubated with the anti-his antibody and the detection antibody.

FIG. 47/1

Cytotoxic activity induced by designated cross-species specific single domain bispecific single chain constructs redirected to indicated target cell lines. A) Stimulated CD4–/CD56– human PBMCs were used as effector cells, CHO cells transfected with human EGFR as target cells. B) The macaque T cell line 4119 LnPx was used as source of effector cells, CHO cells transfected with macaque EGFR were used as target cells. The assay was performed as described in Example 24.6.

FIG. 47/2

Cytotoxic activity induced by designated cross-species specific single domain bispecific single chain constructs redirected to indicated target cell lines. A) Stimulated CD4–/CD56– human PBMCs were used as effector cells, CHO cells transfected with human EGFR as target cells. B) The macaque T cell line 4119 LnPx was used as source of effector cells, CHO cells transfected with macaque EGFR as target cells. The assay was performed as described in Example 24.6.

FIG. 48

52 days after the first immunization antibody serum titers against the CD3-positive human T cell line HPB-ALL and the macaque CD3-positive T cell line 4119LnPx were tested in flow cytometry according to standard protocols. To this end 200.000 cells of the respective cell lines were incubated for 30 min on ice with 50 µl of serum of the immunized animals diluted 1:1000 in PBS with 2% FCS. The cells were washed twice in PBS with 2% FCS and binding of serum antibodies was detected with a FITC conjugated Goat anti-Llama IgG-H&L Antibody diluted 1:100 in 50 µl PBS with 2% FCS. Serum of the animals obtained prior to immunization was used as a negative control (filled curve). Flow cytometry was performed and analyzed. Reactivity to the CD3-positive human T cell line HPB-ALL and the CD3-positive macaque T cell line 4119LnPx of a serum sample of one exemplary animal obtained 52 days after the first immunization was clearly detectable (bold lines).

FIG. 49

Binding of crude preparations of periplasmatically expressed anti-CD3 single domain antibody CD3 3D-H11 to human and non-chimpanzee primate CD3 was tested by flowcytometry on the CD3 positive human T cell leukemia cell line HPB-ALL and the CD3 positive macaque T cell line 4119LnPx. For flow cytometry $2.5 \times 10^5$ cells were incubated with 50 ul periplasmic supernatant. The binding of the constructs was detected with an anti-His antibody followed by PE conjugated goat anti-mouse IgG. The samples were measured on a FACScan™. The filled curves represent the negative controls; the thick lines represent CD3 3D-H11. The overlays of the histograms show cross-species specific binding of anti-CD3 single domain binder CD3 3D-H11 to human and macaque T cells and no binding to CD3 negative CHO cells.

FIG. 50

Binding of crude preparations of periplasmatically expressed anti-CD3 single domain antibody CD3 3D-H11 to immobilized human 1-27 CD3-Fc fusion protein and human 1-27 CD3 BSA conjugate was tested in an ELISA assay. Antigen was immobilized over night and the subsequently blocked wells were then were incubated with crude preparations of periplasmatically expressed single domain antibody at room temperature. After washing with PBS/Tween wells were incubated with peroxidase conjugated anti-Flag® M2 antibody and after washing incubated with of the SIGMAFAST™ OPD (OPD [o-Phenylenediamine dihydrochloride] substrate solution (Sigma-Aldrich Chemie GmbH, Taufkirchen, Germany) according to the manufacturers protocol. Color reaction was stopped and the plate measured on a PowerWaveX™ microplate spectrophotometer at 490 nm and subtraction of background absorption at 620 nm. Binding of detection antibody alone was subtracted. Binding of anti-CD3 single domain antibody CD3 3D-H11 to 1-27 CD3-Fc fusion protein as well as to 1-27 CD3 BSA conjugate could clearly be detected, whereas the signal on the blocking agent alone was negligible.

The present invention is additionally described by way of the following illustrative non-limiting examples that provide a better understanding of the present invention and of its many advantages.

EXAMPLES

1. Identification of CD3epsilon Sequences from Blood Samples of Non-Human Primates Blood samples of the following non-human primates were used for CD3epsilon-identification: *Callithrix jacchus, Saguinus oedipus* and *Saimiris ciureus*. Fresh heparin-treated whole blood samples were prepared for isolating total cellular RNA according to manufacturer's protocol (QIAamp RNA Blood Mini Kit, Qiagen). The extracted mRNA was transcribed into cDNA according to published protocols. In brief, 10 µl of precipitated RNA was incubated with 1.2 µl of 10× hexanucleotide mix (Roche) at 70° C. for 10 minutes and stored on ice. A reaction mix consisting of 4 µl of 5× superscript II buffer, 0.2 µl of 0.1M dithiothreitole, 0.8 µl of superscript II (Invitrogen), 1.2 µl of desoxyribo-nucleoside triphosphates (25 µM), 0.8 µl of RNase Inhibitor (Roche) and 1.8 µl of DNase and RNase free water (Roth) was added. The reaction mix was incubated at room temperature for 10 minutes followed by incubation at 42° C. for 50 minutes and at 90° C. for 5 minutes. The reaction was cooled on ice before adding 0.8 µl of RNaseH (1 U/µl, Roche) and incubated for 20 minutes at 37° C.

The first-strand cDNAs from each species were subjected to separate 35-cycle polymerase chain reactions using Taq DNA polymerase (Sigma) and the following primer combination designed on database research: forward primer 5'-AGAGTTCTGGGCCTCTGC-3' (SEQ ID NO: 253); reverse primer 5'-CGGATGGGCTCATAGTCTG-3' (SEQ ID NO: 254). The amplified 550 bp-bands were gel purified (Gel Extraction Kit, Qiagen) and sequenced (Sequiserve, Vaterstetten/Germany, see sequence listing).

CD3epsilon *Callithrix jacchus*
Nucleotides
CAGGACGGTAATGAAGAAATGGGTGATACTACACAGAACCCATATAAAG

TTTCCATCTCAGGAACCACAGTAACACTGACATGCCCTCGGTATGATGG

ACATGAAATAAAATGGCTCGTAAATAGTCAAAACAAAGAAGGTCATGAG

GACCACCTGTTACTGGAGGACTTTTCGGAAATGGAGCAAAGTGGTTATT

ATGCCTGCCTCTCCAAAGAGACTCCCGCAGAAGAGGCGAGCCATTATCT

CTACCTGAAGGCAAGAGTGTGTGAGAACTGCGTGGAGGTGGAT

Amino acids
(SEQ ID NO: 3)
QDGNEEMGDTTQNPYKVSISGTTVTLTCPRYDGHEIKWLVNSQNKEGHE

DHLLLEDFSEMEQSGYYACLSKETPAEEASHYLYLKARVCENCVEVD

CD3epsilon *Saguinus oedipus*
Nucleotides
CAGGACGGTAATGAAGAAATGGGTGATACTACACAGAACCCATATAAAG

TTTCCATCTCAGGAACCACAGTAACACTGACATGCCCTCGGTATGATGG

ACATGAAATAAAATGGCTTGTAAATAGTCAAAACAAAGAAGGTCATGAG

GACCACCTGTTACTGGAGGATTTTTCGGAAATGGAGCAAAGTGGTTATT

ATGCCTGCCTCTCCAAAGAGACTCCCGCAGAAGAGGCGAGCCATTATCT

CTACCTGAAGGCAAGAGTGTGTGAGAACTGCGTGGAGGTGGAT

Amino acids
(SEQ ID NO: 5)
QDGNEEMGDTTQNPYKVSISGTTVTLTCPRYDGHEIKWLVNSQNKEGHE

DHLLLEDFSEMEQSGYYACLSKETPAEEASHYLYLKARVCENCVEVD

CD3epsilon *Saimiris ciureus*
Nucleotides
CAGGACGGTAATGAAGAGATTGGTGATACTACCCAGAACCCATATAAAG

TTTCCATCTCAGGAACCACAGTAACACTGACATGCCCTCGGTATGATGG

ACAGGAAATAAAATGGCTCGTAAATGATCAAAACAAAGAAGGTCATGAG

GACCACCTGTTACTGGAAGATTTTTCAGAAATGGAACAAAGTGGTTATT

ATGCCTGCCTCTCCAAAGAGACCCCCACAGAAGAGGCGAGCCATTATCT

CTACCTGAAGGCAAGAGTGTGTGAGAACTGCGTGGAGGTGGAT

Amino acids
(SEQ ID NO: 7)
QDGNEEIGDTTQNPYKVSISGTTVTLTCPRYDGQEIKWLVNDQNKEGHE

DHLLLEDFSEMEQSGYYACLSKETPTEEASHYLYLKARVCENCVEVD

2. Generation of Cross-Species Specific Single Chain Antibody Fragments (scFv) Binding to the N-Terminal Amino Acids 1-27 of CD3epsilon of Man and Different Non-Chimpanzee Primates 2.1. Immunization of Mice Using the N-Terminus of CD3epsilon Separated from its Native CD3-Context by Fusion to a Heterologous Soluble Protein Ten weeks old F1 mice from balb/c×C57black crossings were immunized with the CD3epsilon-Fc fusion protein carrying the most N-terminal amino acids 1-27 of the mature CD3epsilon chain (1-27 CD3-Fc) of man and/or *Saimiris ciureus*. To this end 40 µg of the 1-27 CD3-Fc fusion protein with 10 nmol of a thioate-modified CpG-Oligonucleotide (5'-tccatgacgttcctgatgct-3') (SEQ ID No. 343) in 300 ul PBS were injected per mouse intra-peritoneally. Mice receive booster immunizations after 21, 42 and optionally 63 days in the same way. Ten days after the first booster immunization, blood samples were taken and antibody serum titer against 1-27 CD3-Fc fusion protein iwa tested by ELISA. Additionally, the titer against the CD3-positive human T cell line HPB-ALL was tested in flow cytometry according to standard protocols. Serum titers were significantly higher in immunized than in non-immunized animals.

2.2. Generation of an Immune Murine Antibody scFv Library: Construction of a Combinatorial Antibody Library and Phage Display Three days after the last injection the murine spleen cells were harvested for the preparation of total RNA according to standard protocols.

A library of murine immunoglobuline (Ig) light chain (kappa) variable region (VK) and Ig heavy chain variable region (VH) DNA-fragments was constructed by RT-PCR on murine spleen RNA using VK- and VH specific primer. cDNA was synthesized according to standard protocols.

The primers were designed in a way to give rise to a 5'-XhoI and a 3'-BstEII recognition site for the amplified heavy chain V-fragments and to a 5'-Sac and a 3'-SpeI recognition site for amplified VK DNA fragments.

For the PCR-amplification of the VH DNA-fragments eight different 5'-VH-family specific primers (MVH1(GC) AG GTG CAG CTC GAG GAG TCA GGA CCT (SEQ ID No. 344); MVH2 GAG GTC CAG CTC GAG CAG TCT GGA CCT (SEQ ID No. 345); MVH3 CAG GTC CAA CTC GAG CAG CCT GGG GCT (SEQ ID No. 346); MVH4 GAG GTT CAG CTC GAG CAG TCT GGG GCA (SEQ ID No. 347); MVH5 GA(AG) GTG AAG CTC GAG GAG TCT GGA GGA (SEQ ID No. 348); MVH6 GAG GTG AAG CTT CTC GAG TCT GGA GGT (SEQ ID No. 349); MVH7 GAA GTG AAG CTC GAG GAG TCT GGG GGA (SEQ ID No. 350); MVH8 GAG GTT CAG CTC GAG CAG TCT GGA GCT (SEQ ID No. 351)) were each combined with one 3'-VH primer (3'MuVHBstEII tga gga gac ggt gac cgt ggt ccc ttg gcc cca g (SEQ ID No. 352)); for the PCR amplification of the VK-chain fragments seven different 5'-VK-family specific primers (MUVK1 CCA GTT CCG AGC TCG TTG TGA CTC AGG AAT CT (SEQ ID No. 353); MUVK2 CCA GTT CCG AGC TCG TGT TGA CGC AGC CGC CC (SEQ ID No. 354); MUVK3 CCA GTT CCG AGC TCG TGC TCA CCC AGT CTC CA (SEQ ID No. 355); MUVK4 CCA GTT CCG AGC TCC AGA TGA CCC AGT CTC CA (SEQ ID No. 356); MUVK5 CCA GAT GTG AGC TCG TGA TGA CCC AGA CTC CA (SEQ ID No. 357); MUVK6 CCA GAT GTG AGC TCG TCA TGA CCC AGT CTC CA (SEQ ID No. 358); MUVK7 CCA GTT CCG AGC TCG TGA TGA CAC AGT CTC CA (SEQ ID No. 359)) were each combined with one 3'-VK primer (3'MuVkHindIII/BsiW1 tgg tgc act agt cgt acg ttt gat ctc aag ctt ggt ccc (SEQ ID No. 360)).

The following PCR program was used for amplification: denaturation at 94° C. for 20 sec; primer annealing at 52° C. for 50 sec and primer extension at 72° C. for 60 sec and 40 cycles, followed by a 10 min final extension at 72° C. 450 ng of the kappa light chain fragments (SacI-SpeI digested) were ligated with 1400 ng of the phagemid pComb3H5Bhis (SacI-SpeI digested; large fragment). The resulting combinatorial antibody library was then transformed into 300 ul of electrocompetent *Escherichia coli* XL1 Blue cells by electroporation (2.5 kV, 0.2 cm gap cuvette, 25 uFD, 200 Ohm, Biorad gene-pulser) resulting in a library size of more than 107 independent clones. After one hour of phenotype expression, positive transformants were selected for carbenicilline resistance encoded by the pComb3H5BHis vector in 100 ml of liquid super broth (SB)-culture over night. Cells were then harvested by centrifugation and plasmid preparation was carried out using a commercially available plasmid preparation kit (Qiagen). 2800 ng of this plasmid-DNA containing the VK-library (XhoI-BstEII digested; large fragment) were ligated with 900 ng of the heavy chain V-fragments (XhoI-BstEII digested) and again transformed into two 300 ul aliquots of electrocompetent *E. coli* XL1 Blue cells by electroporation (2.5 kV, 0.2 cm gap cuvette, 25 uFD, 200 Ohm) resulting in a total VH-VK scFv (single chain variable fragment) library size of more than 107 independent clones.

After phenotype expression and slow adaptation to carbenicillin, the *E. coli* cells containing the antibody library were transferred into SB-Carbenicillin (50 ug/ml) selection medium. The *E. coli* cells containing the antibody library was then infected with an infectious dose of $10^{12}$ particles of helper phage VCSM13 resulting in the production and secretion of filamentous M13 phage, wherein phage particle contains single stranded pComb3H5BHis-DNA encoding a murine scFv-fragment and displayed the corresponding scFv-protein as a translational fusion to phage coat protein III. This pool of phages displaying the antibody library was later used for the selection of antigen binding entities.

2.3. Phage Display Based Selection of CD3-Specific Binders

The phage library carrying the cloned scFv-repertoire was harvested from the respective culture supernatant by PEG8000/NaCl precipitation and centrifugation. Approximately $10^{11}$ to $10^{12}$ scFv phage particles were resuspended in 0.4 ml of PBS/0.1% BSA and incubated with $10^5$ to $10^7$ Jurkat cells (a CD3-positive human T-cell line) for 1 hour on ice under slow agitation. These Jurkat cells were grown beforehand in RPMI medium enriched with fetal calf serum (10%), glutamine and penicillin/streptomycin, harvested by centrifugation, washed in PBS and resuspended in PBS/1% FCS (containing Na Azide). scFv phage which do not specifically bind to the Jurkat cells were eliminated by up to five washing steps with PBS/1% FCS (containing Na Azide). After washing, binding entities were eluted from the cells by resuspending the cells in HCl-glycine pH 2.2 (10 min incubation with subsequent vortexing) and after neutralization with 2 M Tris pH 12, the eluate was used for infection of a fresh uninfected *E. coli* XL1 Blue culture (OD600>0.5). The *E. coli* culture containing *E. coli* cells successfully transduced with a phagemid copy, encoding a human scFv-fragment, were again selected for carbenicillin resistance and subsequently infected with VCMS 13 helper phage to start the second round of antibody display and in vitro selection. A total of 4 to 5 rounds of selections were carried out, normally.

2.4. Screening for CD3-Specific Binders

Plasmid DNA corresponding to 4 and 5 rounds of panning was isolated from *E. coli* cultures after selection. For the production of soluble scFv-protein, VH-VL-DNA fragments were excised from the plasmids (XhoI-SpeI). These fragments were cloned via the same restriction sites in the plasmid pComb3H5BFlag/His differing from the original pComb3H5BHis in that the expression construct (e.g. scFv) includes a Flag-tag (TGD YKDDDDK SEQ ID NO. 433) between the scFv and the His6-tag and the additional phage proteins were deleted. After ligation, each pool (different rounds of panning) of plasmid DNA was transformed into 100 µl heat shock competent *E. coli* TG1 or XLI blue and plated onto carbenicillin LB-agar. Single colonies were picked into 100 ul of LB carb (50 ug/ml).

*E. coli* transformed with pComb3H5BHis containing a VL- and VH-segment produce soluble scFv in sufficient amounts after excision of the gene III fragment and induction with 1 mM IPTG. Due to a suitable signal sequence, the scFv-chain was exported into the periplasma where it folds into a functional conformation.

Single *E. coli* TG1 bacterial colonies from the transformation plates were picked for periplasmic small scale preparations and grown in SB-medium (e.g. 10 ml) supplemented with 20 mM MgCl2 and carbenicillin 50 µg/ml (and re-dissolved in PBS (e.g. 1 ml) after harvesting. By four rounds of freezing at −70° C. and thawing at 37° C., the outer membrane of the bacteria was destroyed by temperature shock and the soluble periplasmic proteins including the scFvs were released into the supernatant. After elimination of intact cells and cell-debris by centrifugation, the supernatant containing the human anti-human CD3-scFvs was collected and used for further examination.

2.5. Identification of CD3-Specific Binders

Binding of the isolated scFvs was tested by flow cytometry on eukaryotic cells, which on their surface express a heterologous protein displaying at its N-terminus the first 27 N-terminal amino acids of CD3epsilon.

As described in Example 4, the first amino acids 1-27 of the N-terminal sequence of the mature CD3 epsilon chain of the human T cell receptor complex (amino acid sequence: QDGNEEMGGITQTPYKVSISGTTVILT SEQ ID NO: 2) were fused to the N-terminus of the transmembrane protein EpCAM so that the N-terminus was located at the outer cell surface. Additionally, a FLAG epitope was inserted between the N-terminal 1-27 CD3epsilon sequence and the EpCAM sequence. This fusion product was expressed in human embryonic kidney (HEK) and chinese hamster ovary (CHO) cells.

Eukaryotic cells displaying the 27 most N-terminal amino acids of mature CD3epsilon of other primate species were prepared in the same way for *Saimiri* ciureus (Squirrel monkey) (CD3epsilon N-terminal amino acid sequence: QDGNEEIGDTTQNPYKVSISGTTVTLT SEQ ID NO: 8), for *Callithrix jacchus* (CD3epsilon N-terminal amino acid sequence: QDGNEEMGDTTQNPYKVSISGTTVTLT SEQ ID NO: 4) and for *Saguinus oedipus* (CD3epsilon N-terminal amino acid sequence: QDGNEEMGDTTQNPYKVSIS-GTTVTLT SEQ ID NO: 6).

For flow cytometry $2.5 \times 10^5$ cells are incubated with 50 ul supernatant or with 5 μg/ml of the purified constructs in 50 μl PBS with 2% FCS. The binding of the constructs was detected with an anti-His antibody (Penta-His Antibody, BSA free, Qiagen GmbH, Hilden, FRG) at 2 μg/ml in 50 μl PBS with 2% FCS. As a second step reagent a R-Phyco-erythrin-conjugated affinity purified F(ab')2 fragment, goat anti-mouse IgG (Fc-gamma fragment specific), diluted 1:100 in 50 μl PBS with 2% FCS (Dianova, Hamburg, FRG) was used. The samples were measured on a FACScan™ (BD biosciences, Heidelberg, FRG).

Binding was always confirmed by flowcytometry as described in the foregoing paragraph on primary T cells of man and different primates (e.g. *Saimiris ciureus, Callithrix jacchus, Saguinus oedipus*).

2.6. Generation of Human/Humanized Equivalents of Non-Human CD3epsilon Specific scFvs The VH region of the murine anti-CD3 scFv was aligned against human antibody germline amino acid sequences. The human antibody germline VH sequence was chosen which has the closest homology to the non-human VH and a direct alignment of the two amino acid sequences was performed. There were a number of framework residues of the non-human VH that differ from the human VH framework regions ("different framework positions"). Some of these residues may contribute to the binding and activity of the antibody to its target.

To construct a library that contain the murine CDRs and at every framework position that differs from the chosen human VH sequence both possibilities (the human and the maternal murine amino acid residue), degenerated oligo-nucleotides were synthesized. These oligonucleotides incorporate at the differing positions the human residue with a probability of 75% and the murine residue with a probability of 25%. For one human VH e.g. six of these oligonucleotides had to be synthesized that overlap in a terminal stretch of approximately 20 nucleotides. To this end every second primer was an antisense primer. Restriction sites needed for later cloning within the oligonucleotides were deleted.

These primers may have a length of 60 to 90 nucleotides, depending on the number of primers that were needed to span over the whole V sequence.

These e.g. six primers were mixed in equal amounts (e.g. 1 μl of each primer (primer stocks 20 to 100 μM) to a 20 μl PCR reaction) and added to a PCR mix consisting of PCR buffer, nucleotides and Taq polymerase. This mix was incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product was run in an agarose gel electrophoresis and the product of a size from 200 to 400 isolated from the gel according to standard methods.

This PCR product was then used as a template for a standard PCR reaction using primers that incorporate N-terminal and C-terminal suitable cloning restriction sites. The DNA fragment of the correct size (for a VH approximately 350 nucleotides) was isolated by agarose gel electrophoresis according to standard methods. In this way sufficient VH DNA fragment was amplified. This VH fragment was now a pool of VH fragments that have each one a different amount of human and murine residues at the respective differing framework positions (pool of humanized VH). The same procedure was performed for the VL region of the murine anti-CD3 scFv (pool of humanized VL).

The pool of humanized VH was then combined with the pool of humanized VL in the phage display vector pComb3H5Bhis to form a library of functional scFvs from which—after display on filamentous phage—anti-CD3 binders were selected, screened, identified and confirmed as described above for the parental non-human (murine) anti-CD3 scFv. Single clones were then analyzed for favorable properties and amino acid sequence. Those scFvs which were closest in amino acid sequence homology to human germline V-segments are preferred particularly those wherein at least one CDR among CDR I and II of VH and CDR I and II of VLkappa or CDR I and II of VLlambda shows more than 80% amino acid sequence identity to the closest respective CDR of all human germline V-segments. Anti-CD3 scFvs were converted into recombinant bispecific single chain antibodies as described in the following Examples 9, 16, and 24.

3. Generation of a Recombinant Fusion Protein of the N-Terminal Amino Acids 1-27 of the Human CD3 Epsilon Chain Fused to the Fc-Part of an IgG1 (1-27 CD3-Fc).

3.1. Cloning and Expression of 1-27 CD3-Fc

Figure 2:
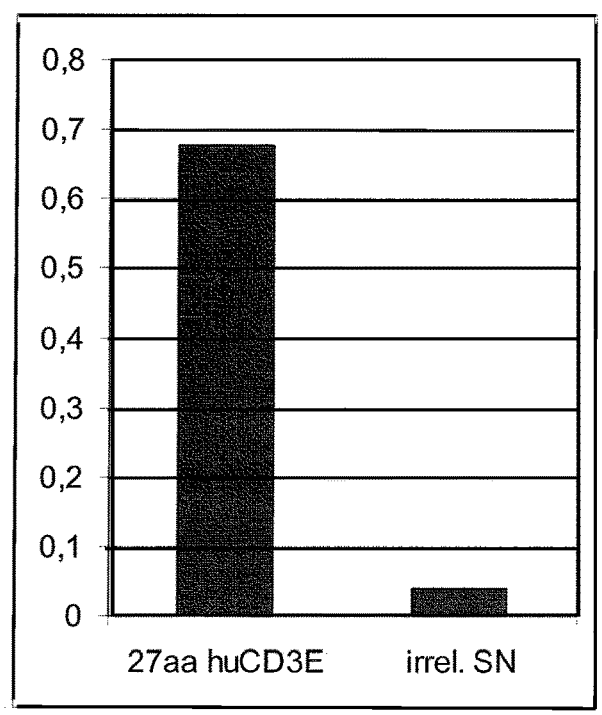

The coding sequence of the 1-27 N-terminal amino acids of the human CD3 epsilon chain fused to the hinge and Fc gamma region of human immunoglobulin IgG1 as well as an 6 Histidine Tag were obtained by gene synthesis according to standard protocols (cDNA sequence and amino acid sequence of the recombinant fusion protein are listed under SEQ ID NOs 230 and 229). The gene synthesis fragment was designed as to contain first a Kozak site for eukaryotic expression of the construct, followed by an 19 amino acid immunoglobulin leader peptide, followed in frame by the coding sequence of the first 27 amino acids of the extracellular portion of the mature human CD3 epsilon chain, followed in frame by the coding sequence of the hinge region and Fc gamma portion of human IgG1, followed in frame by the coding sequence of a 6 Histidine tag and a stop codon (FIG. 1). The gene synthesis fragment was also designed as to introduce restriction sites at the beginning and at the end of the cDNA coding for the fusion protein. The introduced restriction sites, EcoRI at the 5' end and SalI at the 3' end, are utilized in the following cloning procedures. The gene synthesis fragment was cloned via EcoRI and SalI into a plasmid designated pEF-DHFR (pEF-DHFR is described in Mack et al. Proc. Natl. Acad. Sci. USA 92 (1995) 7021-7025) following standard protocols. A sequence verified plasmid was used for transfection in the FreeStyle™ 293 Expression System (Invitrogen GmbH, Karlsruhe, Germany) according to the manufacturers protocol. After 3 days cell culture supernatants of the transfectants were harvested and tested for the presence of the recombinant construct in an ELISA assay. Goat anti-human IgG, Fc-gamma fragment specific antibody (obtained from Jackson ImmunoResearch Europe Ltd., Newmarket, Suffolk, UK) was diluted in PBS to 5 µg/ml and coated with 100 µl per well onto a MaxiSorp™ 96-well ELISA plate (Nunc GmbH & Co. KG, Wiesbaden, Germany) over night at 4° C. Wells were washed with PBS with 0.05% TWEEN® 20 (PBS/Tween and blocked with 3% BSA in PBS (bovine Albumin, fraction V, Sigma-Aldrich Chemie GmbH, Taufkirchen, Germany) for 60 minutes at room temperature (RT). Subsequently, wells were washed again PBS/Tween and then incubated with cell culture supernatants for 60 minutes at RT. After washing wells were incubated with a peroxidase conjugated anti-His6 antibody (Roche Diagnostics GmbH, Roche Applied Science, Mannheim, Germany) diluted 1:500 in PBS with 1% BSA for 60 minutes at RT. Subsequently, wells were washed with 200 µl PBS/Tween and 100 µl of the SIGMAFAST™ OPD (SIGMAFAST™ OPD [o-Phenylenediamine dihydrochloride] substrate solution (Sigma-Aldrich Chemie GmbH, Taufkirchen, Germany) was added according to the manufacturers protocol. The reaction was stopped by adding 100 µl 1 M $H_2SO_4$. Color reaction was measured on a PowerWaveX™ microplate spectrophotometer (BioTek Instruments, Inc., Winooski, Vermont, USA) at 490 nm and subtraction of background absorption at 620 nm. As shown in FIG. 2 presence of the construct as compared to irrelevant supernatant of mock-transfected HEK 293 cells used as negative control was clearly detectable.

3.2. Binding assay of cross-species specific single chain antibodies to 1-27 CD3-Fc.

Figure 3:
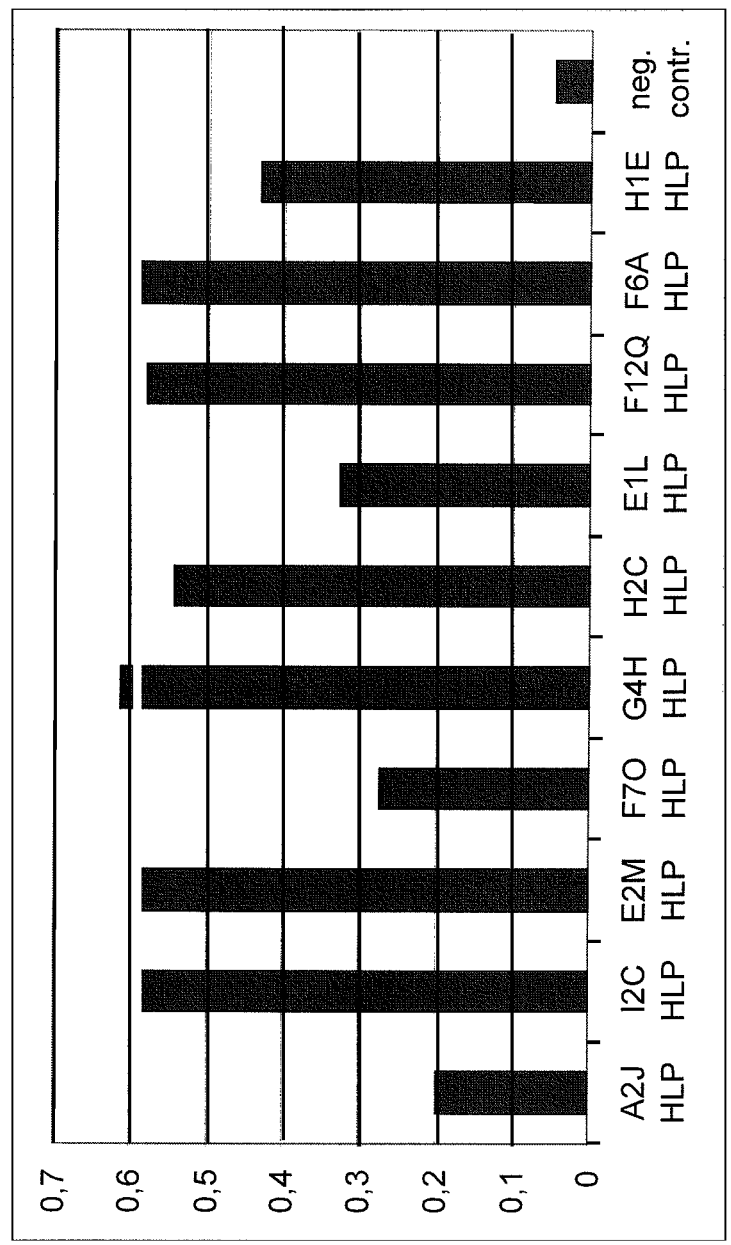

Binding of crude preparations of periplasmatically expressed cross-species specific single chain antibodies specific for CD3 epsilon to 1-27 CD3-Fc was tested in an ELISA assay. Goat anti-human IgG, Fc-gamma fragment specific antibody (Jackson ImmunoResearch Europe Ltd., Newmarket, Suffolk, UK) was diluted in PBS to 5 µg/ml and coated with 100 µl per well onto a MaxiSorp™ 96-well ELISA plate (Nunc GmbH & Co. KG, Wiesbaden, Germany) over night at 4° C. Wells were washed with PBS with 0.05% TWEEN® 20 (PBS/Tween and blocked with PBS with 3% BSA (bovine Albumin, fraction V, Sigma-Aldrich Chemie GmbH, Taufkirchen, Germany) for 60 minutes at RT. Subsequently, wells were washed with PBS/Tween and incubated with supernatants of cells expressing the 1-27 CD3-Fc construct for 60 minutes at RT. Wells were washed with PBS/Tween and incubated with crude preparations of periplasmatically expressed cross-species specific single-chain antibodies as described above for 60 minutes at room temperature. After washing with PBS/Tween wells were incubated with peroxidase conjugated anti-Flag® M2 antibody (Sigma-Aldrich Chemie GmbH, Taufkirchen, Germany) diluted 1:10000 in PBS with 1% BSA for 60 minutes at RT. Wells were washed with PBS/Tween and incubated with 100 µl of the SIGMAFAST™ OPD (OPD [o-Phenylenediamine dihydrochloride] substrate solution (Sigma-Aldrich Chemie GmbH, Taufkirchen, Germany) according to the manufacturers protocol. Color reaction was stopped with 100 µl 1 M $H_2SO_4$ and measured on a PowerWaveX™ microplate spectrophotometer (BioTek Instruments, Inc., Winooski, Vermont, USA) at 490 nm and subtraction of background absorption at 620 nm. Strong binding of cross-species specific human single chain antibodies specific for CD3 epsilon to the 1-27 CD3-Fc construct compared to a murine anti CD3 single-chain antibody was observed (FIG. 3).

4. Generation of Recombinant Transmembrane Fusion Proteins of the N-Terminal Amino Acids 1-27 of CD3 Epsilon from Different Non-Chimpanzee Primates Fused to EpCAM from Cynomolgus Monkey (1-27 CD3-EpCAM).

4.1. Cloning and Expression of 1-27 CD3-EpCAM

Figure 4:
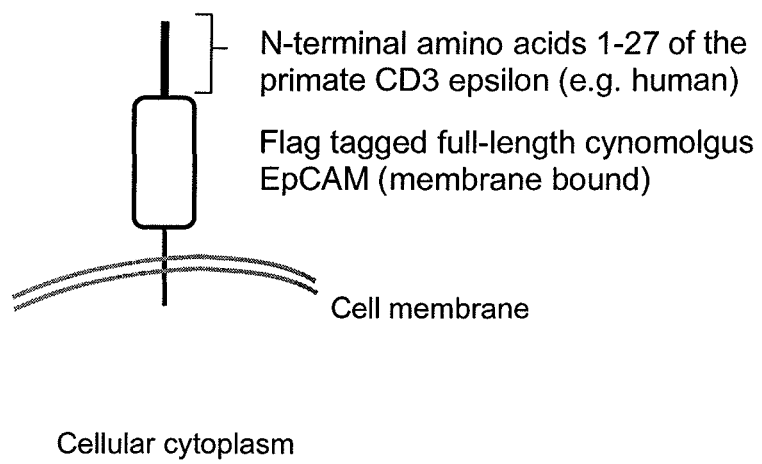
Figure 5:
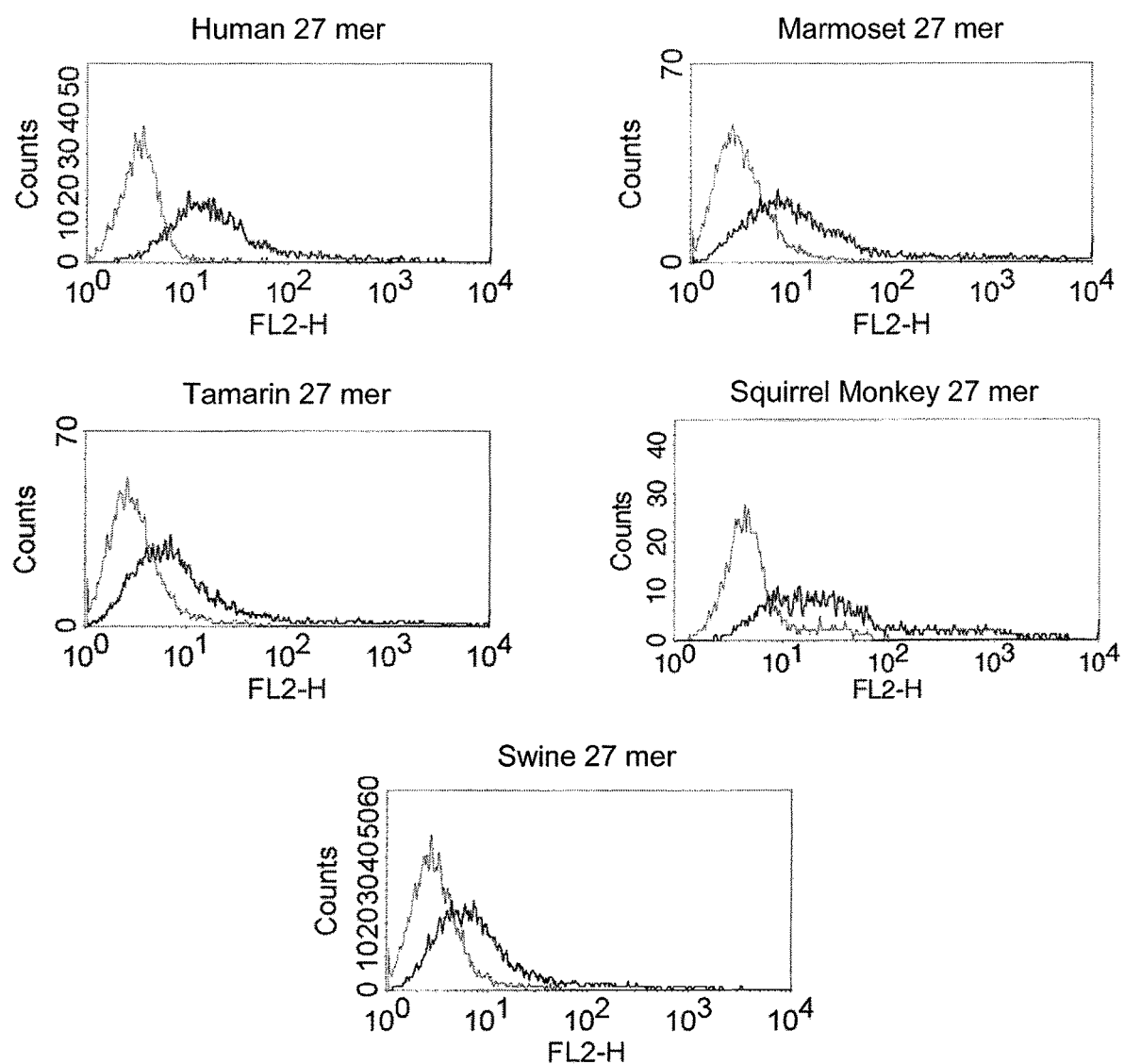
Figure 6A:
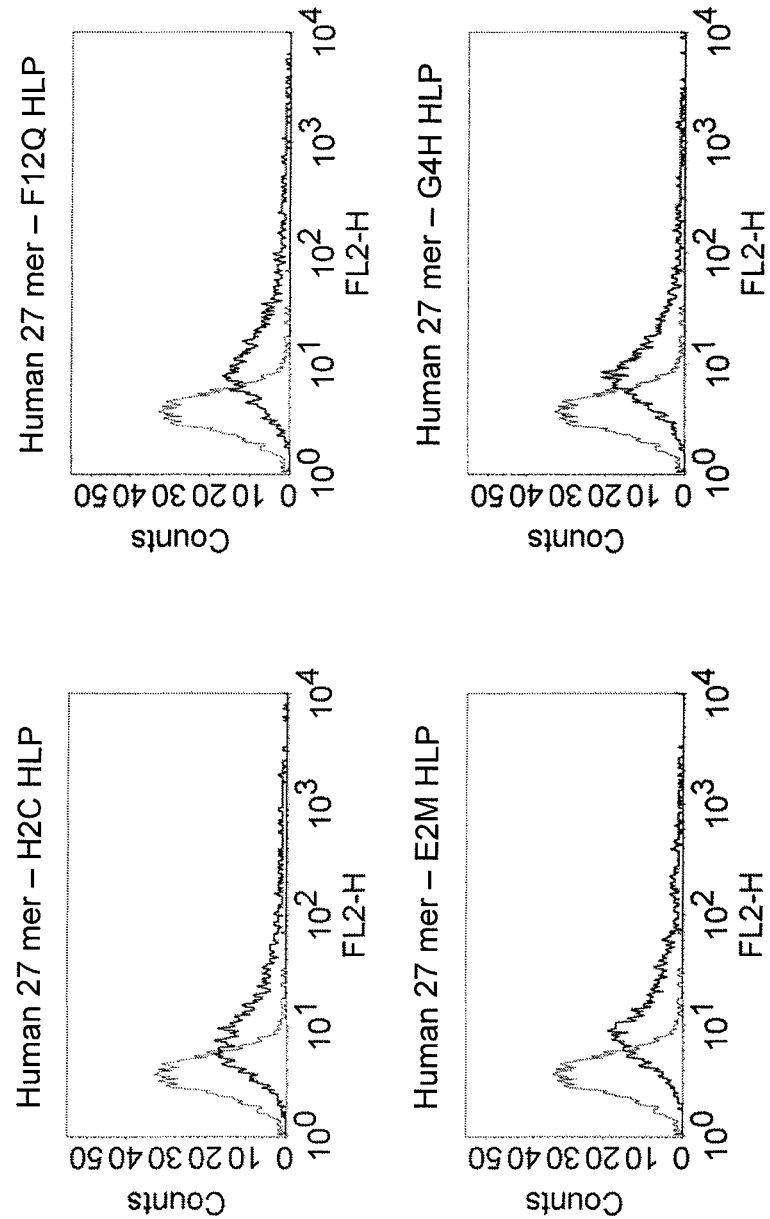
Figure 6B:
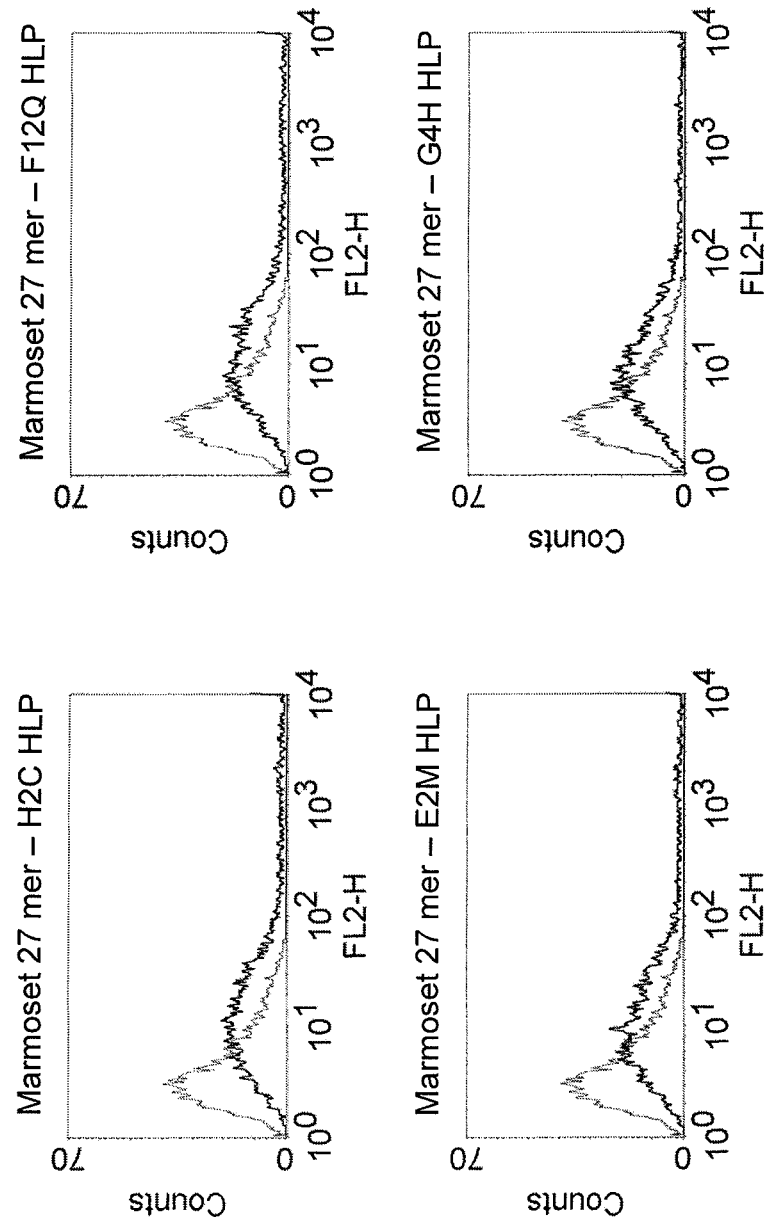
Figure 6C:
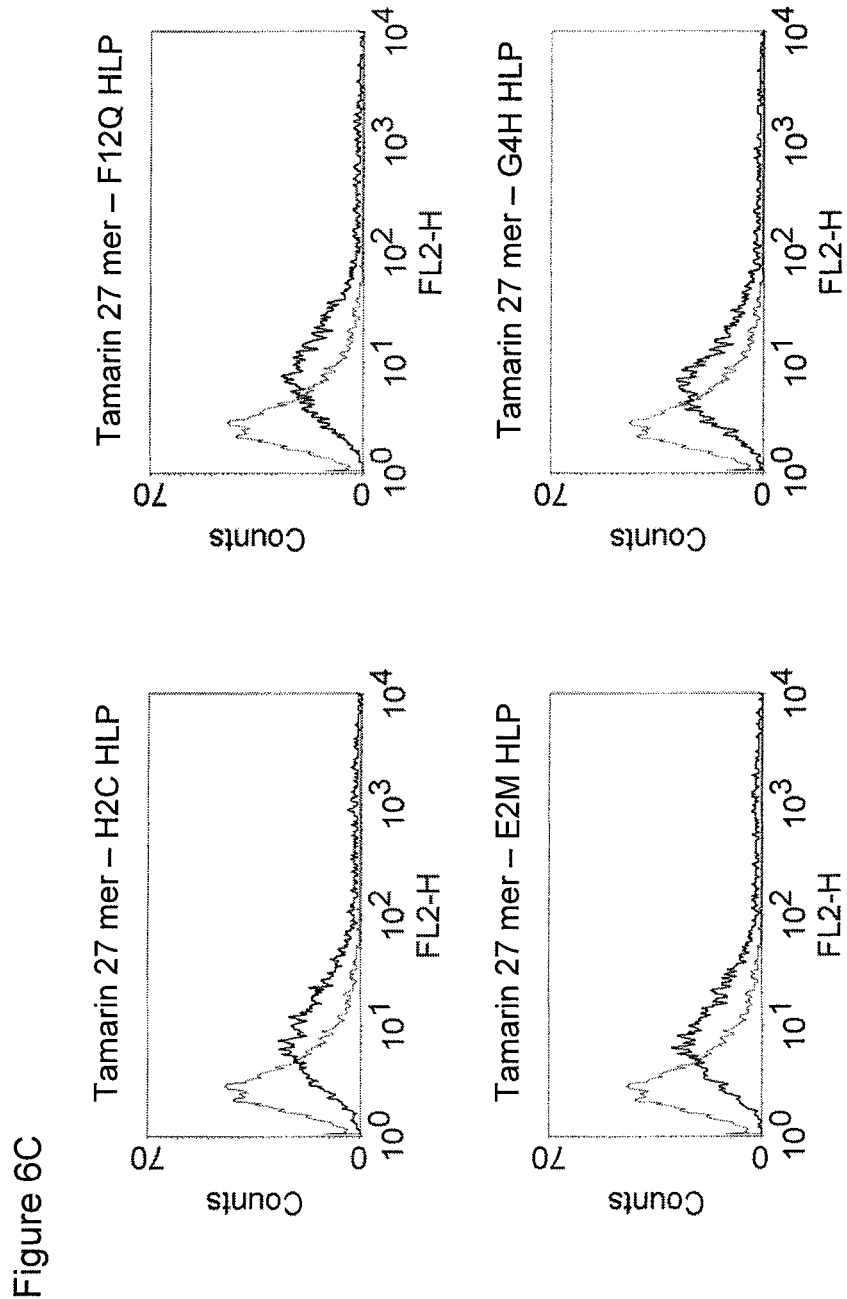
Figure 6D:
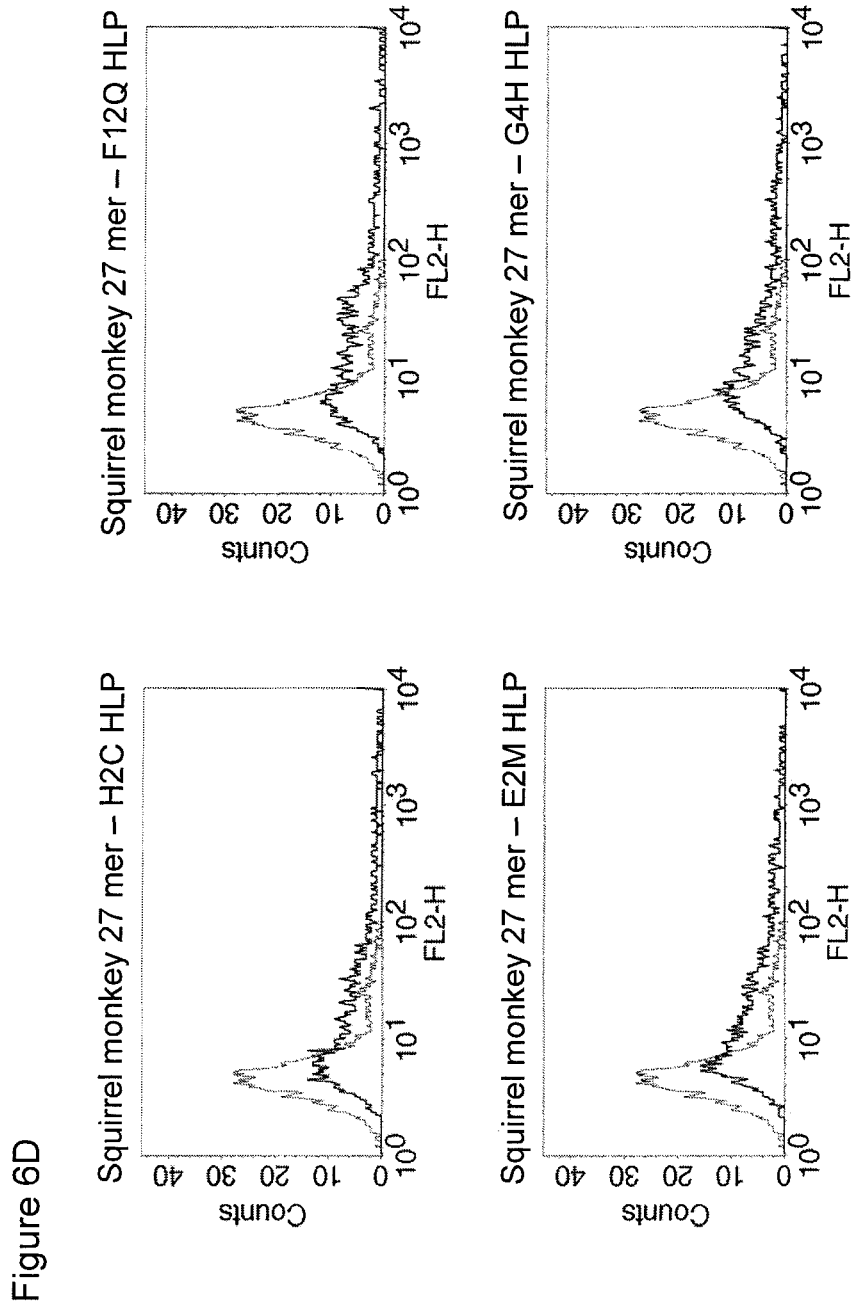
Figure 6E:
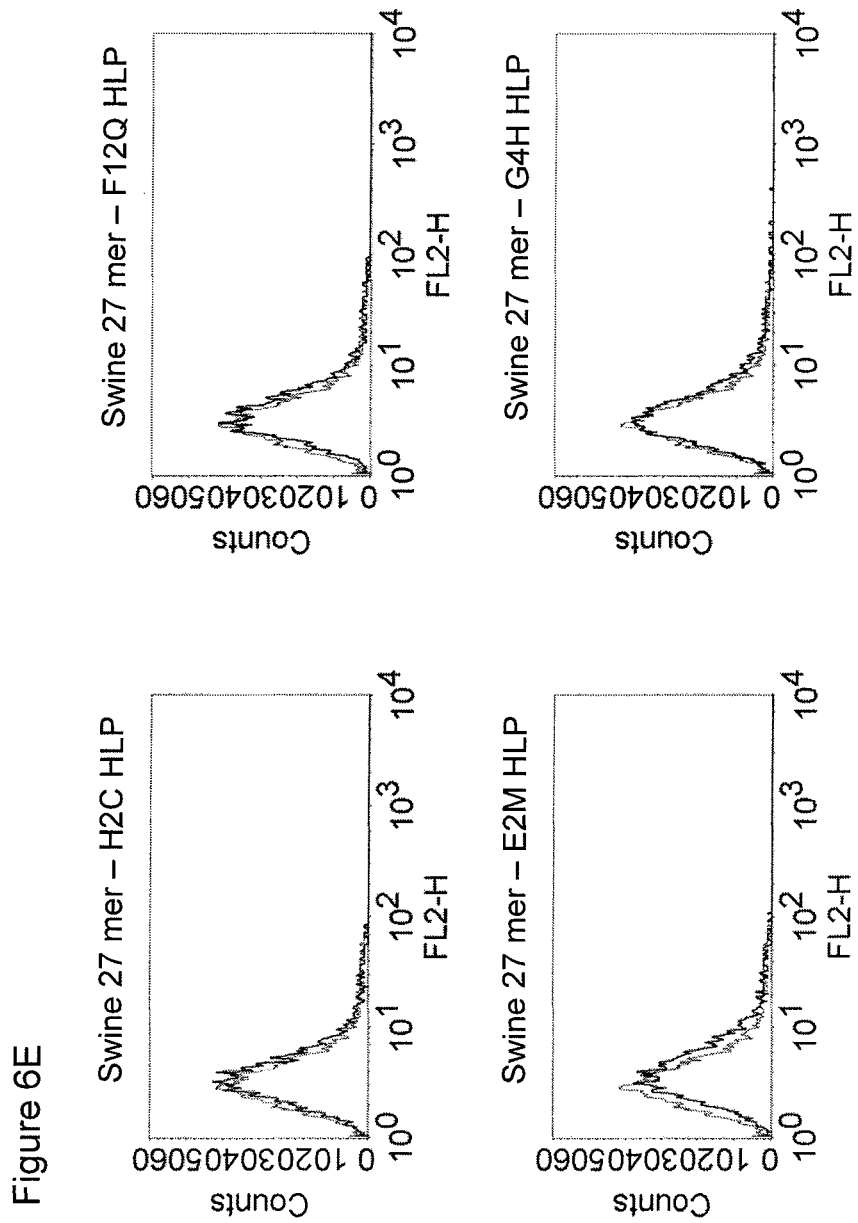

CD3 epsilon was isolated from different non-chimpanzee primates (marmoset, tamarin, squirrel monkey) and swine. The coding sequences of the 1-27 N-terminal amino acids of CD3 epsilon chain of the mature human, common marmoset (*Callithrix jacchus*), cottontop tamarin (*Saguinus oedipus*), common squirrel monkey (*Saimiri sciureus*) and domestic swine (*Sus scrofa*; used as negative control) fused to the N-terminus of Flag tagged cynomolgus EpCAM were obtained by gene synthesis according to standard protocols. cDNA sequence and amino acid sequence of the recombinant fusion proteins are listed under SEQ ID NOs 231 to 240). The gene synthesis fragments were designed as to contain first a BsrGI site to allow fusion in correct reading frame with the coding sequence of a 19 amino acid immunoglobulin leader peptide already present in the target expression vector, which is followed in frame by the coding sequence of the N-terminal 1-27 amino acids of the extracellular portion of the mature CD3 epsilon chains, which is followed in frame by the coding sequence of a Flag tag and followed in frame by the coding sequence of the mature cynomolgus EpCAM transmembrane protein (FIG. 4). The gene synthesis fragments were also designed to introduce a restriction site at the end of the cDNA coding for the fusion protein. The introduced restriction sites BsrGI at the 5' end and SalI at the 3' end, were utilized in the following cloning procedures. The gene synthesis fragments were then cloned via BsrGI and SalI into a derivative of the plasmid designated pEF DHFR (pEF-DHFR is described in Mack et al. Proc. Natl. Acad. Sci. USA 92 (1995) 7021-7025), which already contained the coding sequence of the 19 amino acid immunoglobulin leader peptide following standard protocols. Sequence verified plasmids were used to transiently transfect 293-HEK cells using the MATra-A Reagent (IBA GmbH, Gottingen, Germany) and 12 µg of plasmid DNA for adherent 293-HEK cells in 175 ml cell culture flasks according to the manufacturers protocol. After 3 days of cell culture the transfectants were tested for cell surface expression of the recombinant transmembrane protein via an FACS assay according to standard protocols. For that purpose a number of $2.5 \times 10^5$ cells were incubated with the anti-Flag® M2 antibody (Sigma-Aldrich Chemie GmbH, Taufkirchen, Germany) at 5 µg/ml in PBS with 2% FCS. Bound antibody was detected with an R-Phycoerythrin-conjugated affinity purified F(ab')2 fragment, goat anti-mouse IgG, Fc-gamma fragment specific 1:100 in PBS with 2% FCS (Jackson ImmunoResearch Europe Ltd., Newmarket, Suffolk, UK). The samples were measured on a FACSCalibur™ (BD biosciences, Heidelberg, Germany). Expression of the Flag tagged recombinant transmembrane fusion proteins consisting of cynomolgus EpCAM and the 1-27 N-terminal amino acids of the human, marmoset, tamarin, squirrel monkey and swine CD3 epsilon chain respectively on transfected cells was clearly detectable (FIG. 5).

4.2. Binding of Cross-Species Specific Anti-CD3 Single Chain Antibodies to the 1-27 CD3-EpCAM Binding of crude preparations of periplasmatically expressed cross-species specific anti CD3 single-chain antibodies to the 1-27 N-terminal amino acids of the human, marmoset, tamarin and squirrel monkey CD3 epsilon chains respectively fused to cynomolgus Ep-CAM was tested in an FACS assay according to standard protocols. For that purpose a number of $2.5 \times 10^5$ cells were incubated with crude preparations of periplasmatically expressed cross-species specific anti CD3 single-chain antibodies (preparation was performed as described above and according to standard protocols) and a single-chain murine anti-human CD3 antibody as negative control. As secondary antibody the Penta-His antibody (Qiagen GmbH, Hildesheim, Germany) was used at 5 μg/ml in 50 μl PBS with 2% FCS. The binding of the antibody was detected with an R-Phycoerythrin-conjugated affinity purified F(ab')$_2$ fragment, goat anti-mouse IgG, Fc-gamma fragment specific, diluted 1:100 in PBS with 2% FCS (Jackson ImmunoResearch Europe Ltd., Newmarket, Suffolk, UK). The samples were measured on a FACSCalibur™ (BD biosciences, Heidelberg, Germany). As shown in FIGS. 6A-6E binding of single chain antibodies to the transfectants expressing the recombinant transmembrane fusion proteins consisting of the 1-27 N-terminal amino acids of CD3 epsilon of the human, marmoset, tamarin or squirrel monkey fused to cynomolgus EpCAM was observed. No binding of cross-species specific single chain antibodies was observed to a fusion protein consisting of the 1-27 N-terminal CD3 epsilon of swine fused to cynomolgus EpCAM used as negative control. Multi-primate cross-species specificity of the anti-CD3 single chain antibodies was shown. Signals obtained with the anti Flag M2 antibody and the cross-species specific single chain antibodies were comparable, indicating a strong binding activity of the cross-species specific single chain antibodies to the N-terminal amino acids 1-27 of CD3 epsilon.

Figure 7:
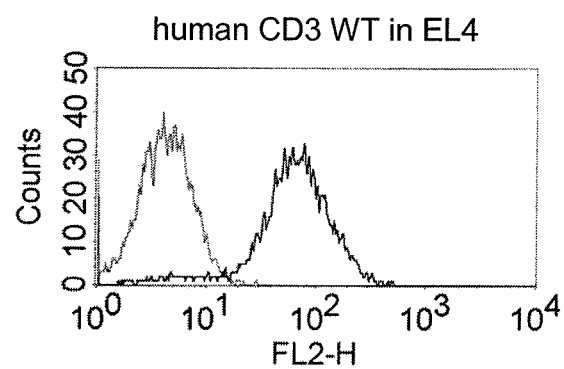
Figure 8A:
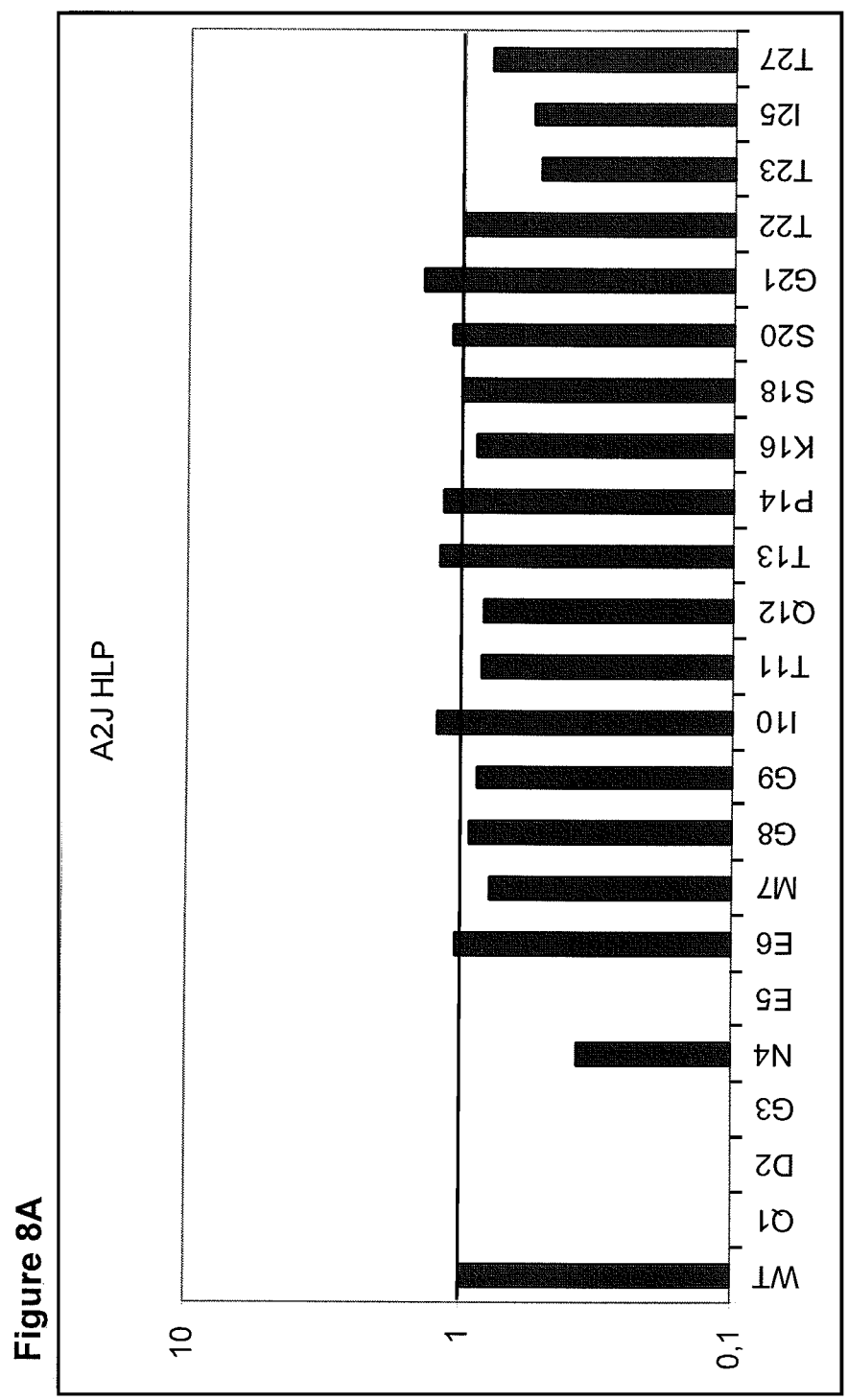
Figure 8B:
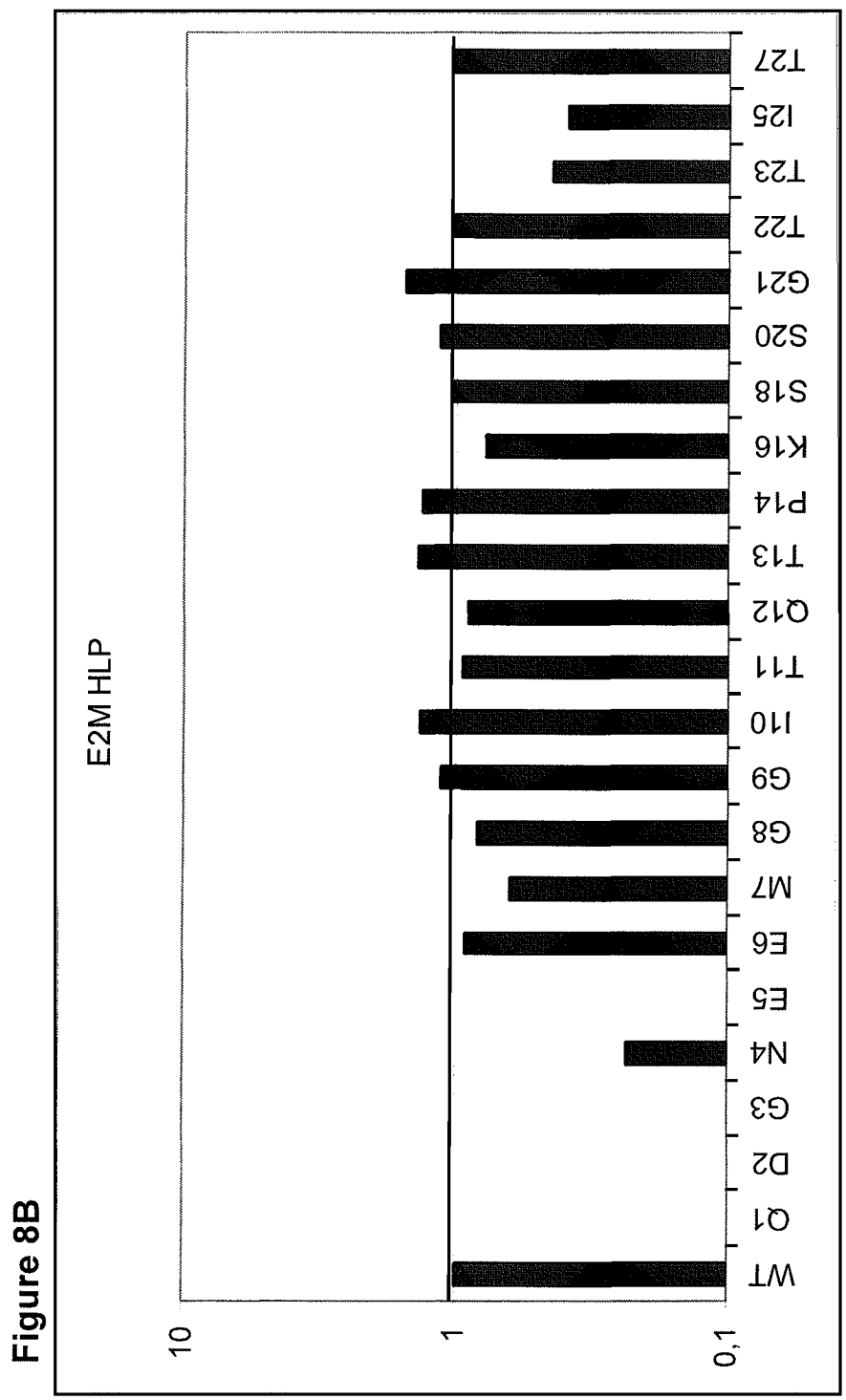
Figure 8C:
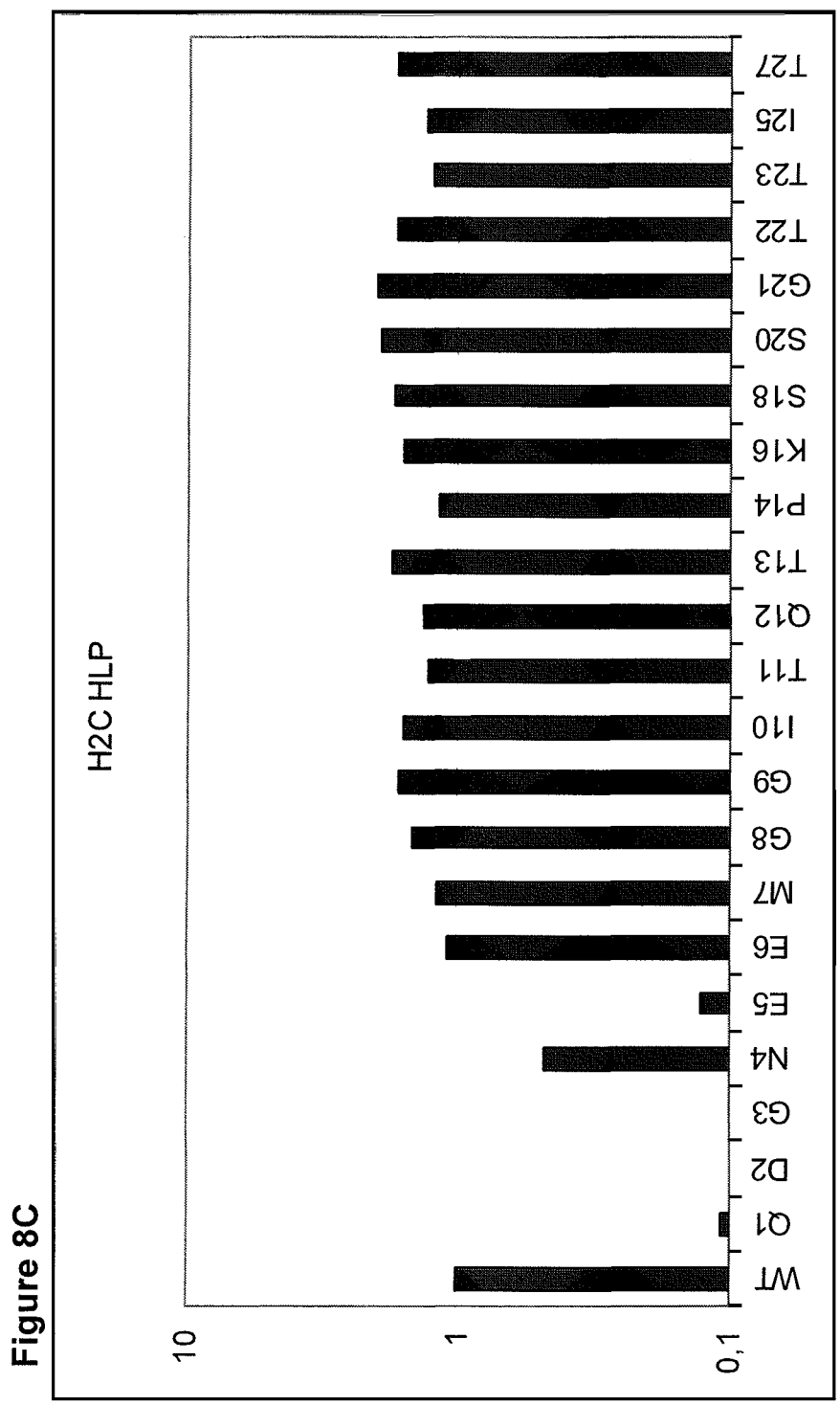
Figure 8D:
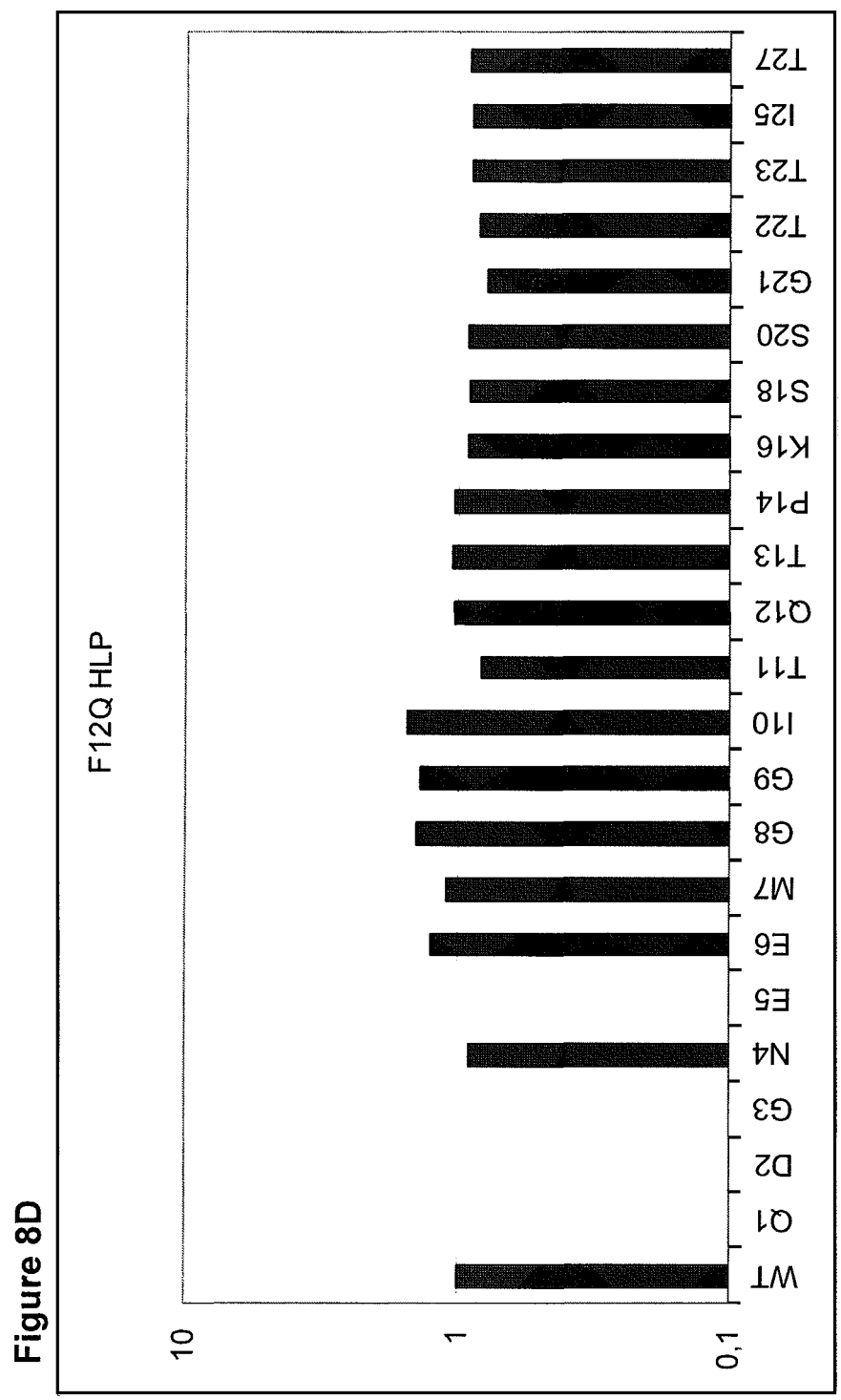

5. Binding Analysis of Cross-Species Specific Anti-CD3 Single Chain Antibodies by Alanine-Scanning of Mouse Cells Transfected with the Human CD3 Epsilon Chain and its Alanine Mutants 5.1. Cloning and Expression of Human Wild-Type CD3 Epsilon The coding sequence of the human CD3 epsilon chain was obtained by gene synthesis according to standard protocols (cDNA sequence and amino acid sequence of the human CD3 epsilon chain are listed under SEQ ID NOs 242 and 241). The gene synthesis fragment was designed as to contain a Kozak site for eukaryotic expression of the construct and restriction sites at the beginning and the end of the cDNA coding for human CD3 epsilon. The introduced restriction sites EcoRI at the 5' end and SalI at the 3' end, were utilized in the following cloning procedures. The gene synthesis fragment was then cloned via EcoRI and SalI into a plasmid designated pEF NEO following standard protocols. pEF NEO was derived of pEF DHFR (Mack et al. Proc. Natl. Acad. Sci. USA 92 (1995) 7021-7025) by replacing the cDNA of the DHFR with the cDNA of the neomycin resistance by conventional molecular cloning. A sequence verified plasmid was used to transfect the murine T cell line EL4 (ATCC® No. TIB-39) cultivated in RPMI with stabilized L-glutamine supplemented with 10% FCS, 1% penicillin/streptomycin, 1% HEPES, 1% pyruvate, 1% nonessential amino acids (all Biochrom AG Berlin, Germany) at 37° C., 95% humidity and 7% C02. Transfection was performed with the SuperFect Transfection Reagent (Qiagen GmbH, Hilden, Germany) and 2 μg of plasmid DNA according to the manufacturer's protocol. After 24 hours the cells were washed with PBS and cultivated again in the aforementioned cell culture medium with 600 μg/ml G418 for selection (PAA Laboratories GmbH, Pasching, Austria). 16 to 20 days after transfection the outgrowth of resistant cells was observed. After additional 7 to 14 days cells were tested for expression of human CD3 epsilon by FACS analysis according to standard protocols. $2.5 \times 10^5$ cells were incubated with anti-human CD3 antibody UCHT-1 (BD biosciences, Heidelberg, Germany) at 5 μg/ml in PBS with 2% FCS. The binding of the antibody was detected with an R-Phycoerythrin-conjugated affinity purified F(ab')2 fragment, goat anti-mouse IgG, Fc-gamma fragment specific, diluted 1:100 in PBS with 2% FCS (Jackson ImmunoResearch Europe Ltd., Newmarket, Suffolk, UK). The samples were measured on a FACSCalibur™ (BD biosciences, Heidelberg, Germany). Expression of human wild-type CD3 on transfected EL4 cells is shown in FIG. 7.

5.2. Cloning and Expression of the Cross-Species Specific Anti-CD3 Single Chain Antibodies as IgG1 Antibodies In order to provide improved means of detection of binding of the cross-species specific single chain anti-CD3 antibodies H2C HLP, A2J HLP and E2M HLP were converted into IgG1 antibodies with murine IgG1 and human lambda constant regions. cDNA sequences coding for the heavy and light chains of respective IgG antibodies were obtained by gene synthesis according to standard protocols. The gene synthesis fragments for each specificity were designed as to contain first a Kozak site to allow eukaryotic expression of the construct, which is followed by an 19 amino acid immunoglobulin leader peptide (SEQ ID NOs 244 and 243), which is followed in frame by the coding sequence of the respective heavy chain variable region or respective light chain variable region, followed in frame by the coding sequence of the heavy chain constant region of murine IgG1 (SEQ ID NOs 246 and 245) or the coding sequence of the human lambda light chain constant region (SEQ ID NO 248 and 247), respectively. Restriction sites were introduced at the beginning and the end of the cDNA coding for the fusion protein. Restriction sites EcoRI at the 5' end and SalI at the 3' end were used for the following cloning procedures. The gene synthesis fragments were cloned via EcoRI and SalI into a plasmid designated pEF DHFR (Mack et al. Proc. Natl. Acad. Sci. USA 92 (1995) 7021-7025) for the heavy chain constructs and pEF ADA (pEF ADA is described in Raum et al., Cancer Immunol Immunother., 50(3), (2001), 141-50) for the light chain constructs) according to standard protocols. Sequence verified plasmids were used for co-transfection of respective light and heavy chain constructs in the FreeStyle™ 293 Expression System (Invitrogen GmbH, Karlsruhe, Germany) according to the manufacturers protocol. After 3 days cell culture supernatants of the transfectants were harvested and used for the alanine-scanning experiment.

5.3. Cloning and Expression of Alanine Mutants of Human CD3 Epsilon for Alanine-Scanning 27 cDNA fragments coding for the human CD3 epsilon chain with an exchange of one codon of the wild-type sequence of human CD3 epsilon into a codon coding for alanine (GCC) for each amino acid of amino acids 1-27 of the extracellular domain of the mature human CD3 epsilon chain respectively were obtained by gene synthesis. Except for the exchanged codon the cDNA fragments were identical to the aforementioned human wild-type CD3 cDNA fragment. Only one codon was replaced in each construct compared to the human wild-type CD3 cDNA fragment described above. Restriction sites EcoRI and SalI were introduced into the cDNA fragments at identical positions compared to the wild-type construct. All alanine-scanning constructs were cloned into pEF NEO and sequence verified plasmids were transfected into EL4 cells. Transfection and selection of transfectants was performed as described above. As result a panel of expressed constructs was obtained wherein the first amino acid of the human CD3 epsilon chain, glutamine (Q, Gln) at position 1 was replaced by alanine. The last amino acid replaced by alanine was the threonine (T, Thr) at position 27 of mature human wild-type CD3 epsilon. For each amino acid between glutamine 1 and threonine 27 respective transfectants with an exchange of the wild-type amino acid into alanine were generated.

5.4. Alanine-Scanning Experiment

Chimeric IgG antibodies as described in 5.2 and cross-species specific single chain antibodies specific for CD3 epsilon were tested in alanine-scanning experiment. Binding of the antibodies to the EL4 cell lines transfected with the alanine-mutant constructs of human CD3 epsilon as described in 5.3 was tested by FACS assay according to standard protocols. 2.5×10⁵ cells of the respective transfectants were incubated with 50 µl of cell culture supernatant containing the chimeric IgG antibodies or with 50 µl of crude preparations of periplasmatically expressed single-chain antibodies. For samples incubated with crude preparations of periplasmatically expressed single-chain antibodies the anti-Flag® M2 antibody (Sigma-Aldrich Chemie GmbH, Taufkirchen, Germany) was used as secondary antibody at 5 µg/ml in 50 µl PBS with 2% FCS. For samples incubated with the chimeric IgG antibodies a secondary antibody was not necessary. For all samples the binding of the antibody molecules was detected with an R-Phycoerythrin-conjugated affinity purified F(ab')2 fragment, goat anti-mouse IgG, Fc-gamma fragment specific, diluted 1:100 in PBS with 2% FCS (Jackson ImmunoResearch Europe Ltd., Newmarket, Suffolk, UK). Samples were measured on a FACSCalibur™ (BD biosciences, Heidelberg, Germany). Differential binding of chimeric IgG molecules or cross-species specific single-chain antibodies to the EL4 cell lines transfected with the alanine-mutants of human CD3 epsilon was detected. As negative control either an isotype control or a crude preparation of a periplasmatically expressed single-chain antibody of irrelevant specificity was used respectively. UCHT-1 antibody was used as positive control for the expression level of the alanine-mutants of human CD3 epsilon. The EL4 cell lines transfected with the alanine-mutants for the amino acids tyrosine at position 15, valine at position 17, isoleucine at position 19, valine at position 24 or leucine at position 26 of the mature CD3 epsilon chain were not evaluated due to very low expression levels (data not shown). Binding of the cross-species specific single chain antibodies and the single chain antibodies in chimeric IgG format to the EL4 cell lines transfected with the alanine-mutants of human CD3 epsilon is shown in FIGS. 8A-8D as relative binding in arbitrary units with the geometric mean fluorescence values of the respective negative controls subtracted from all respective geometric mean fluorescence sample values. To compensate for different expression levels all sample values for a certain transfectant were then divided through the geometric mean fluorescence value of the UCHT-1 antibody for the respective transfectant. For comparison with the wild-type sample value of a specificity all sample values of the respective specificity were finally divided through the wild-type sample value, thereby setting the wild-type sample value to 1 arbitrary unit of binding. The calculations used are shown in detail in the following formula:

$$\text{value\_Sample}(x, y) = \frac{\text{Sample}(x, y) - \text{neg\_Contr.}(x)}{(UCHT-1(x) - \text{neg\_Contr.}(x)) * \frac{WT(y) - \text{neg\_Contr.}(wt)}{UCHT-1(wt) - \text{neg\_Contr.}(wt)}}$$

In this equation value_Sample means the value in arbitrary units of binding depicting the degree of binding of a specific anti-CD3 antibody to a specific alanine-mutant as shown in FIGS. 8A-8D, Sample means the geometric mean fluorescence value obtained for a specific anti-CD3 antibody assayed on a specific alanine-scanning transfectant, neg_Contr. means the geometric mean fluorescence value obtained for the negative control assayed on a specific alanine-mutant, UCHT-1 means the geometric mean fluorescence value obtained for the UCHT-1 antibody assayed on a specific alanine-mutant, WT means the geometric mean fluorescence value obtained for a specific anti-CD3 antibody assayed on the wild-type transfectant, x specifies the respective transfectant, y specifies the respective anti-CD3 antibody and wt specifies that the respective transfectant is the wild-type.

As can be seen in FIGS. 8A-8D the IgG antibody A2J HLP showed a pronounced loss of binding for the amino acids asparagine at position 4, threonine at position 23 and isoleucine at position 25 of the mature CD3 epsilon chain. A complete loss of binding of IgG antibody A2J HLP was observed for the amino acids glutamine at position 1, aspartate at position 2, glycine at position 3 and glutamate at position 5 of the mature CD3 epsilon chain. IgG antibody E2M HLP showed a pronounced loss of binding for the amino acids asparagine at position 4, threonine at position 23 and isoleucine at position 25 of the mature CD3 epsilon chain. IgG antibody E2M HLP showed a complete loss of binding for the amino acids glutamine at position 1, aspartate at position 2, glycine at position 3 and glutamate at position 5 of the mature CD3 epsilon chain. IgG antibody H2C HLP showed an intermediate loss of binding for the amino acid asparagine at position 4 of the mature CD3 epsilon chain and it showed a complete loss of binding for the amino acids glutamine at position 1, aspartate at position 2, glycine at position 3 and glutamate at position 5 of the mature CD3 epsilon chain. Single chain antibody F12Q HLP showed an essentially complete loss of binding for the amino acids glutamine at position 1, aspartate at position 2, glycine at position 3 of the mature CD3 epsilon chain and glutamate at position 5 of the mature CD3 epsilon chain.

6. Binding Analysis of the Cross-Species Specific Anti-CD3 Binding Molecule H2C HLP to the Human CD3 Epsilon Chain with and without N-Terminal His6 Tag Transfected into the Murine T Cell Line EL4

6.1. Cloning and Expression of the Human CD3 Epsilon Chain with N-Terminal Six Histidine Tag (His6 Tag)

A cDNA fragment coding for the human CD3 epsilon chain with a N-terminal His6 tag was obtained by gene synthesis. The gene synthesis fragment was designed as to contain first a Kozak site for eukaryotic expression of the construct, which is followed in frame by the coding sequence of a 19 amino acid immunoglobulin leader peptide, which is followed in frame by the coding sequence of a His6 tag which is followed in frame by the coding sequence of the mature human CD3 epsilon chain (the cDNA and amino acid sequences of the construct are listed as SEQ ID NOs 256 and 255). The gene synthesis fragment was also designed as to contain restriction sites at the beginning and the end of the cDNA. The introduced restriction sites EcoRI at the 5' end and SalI at the 3' end, were used in the following cloning procedures. The gene synthesis fragment was then cloned via EcoRI and SalI into a plasmid designated pEF-NEO (as described above) following standard protocols. A sequence verified plasmid was used to transfect the murine T cell line EL4. Transfection and selection of the transfectants were performed as described above. After 34 days of cell culture the transfectants were used for the assay described below.

Figure 9:
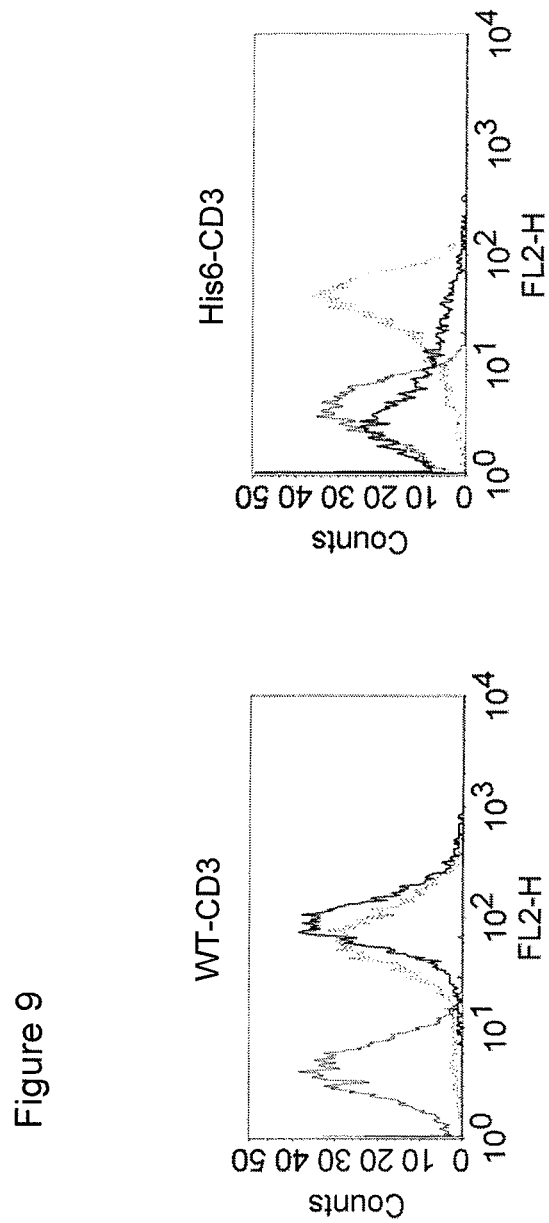
Figure 10:
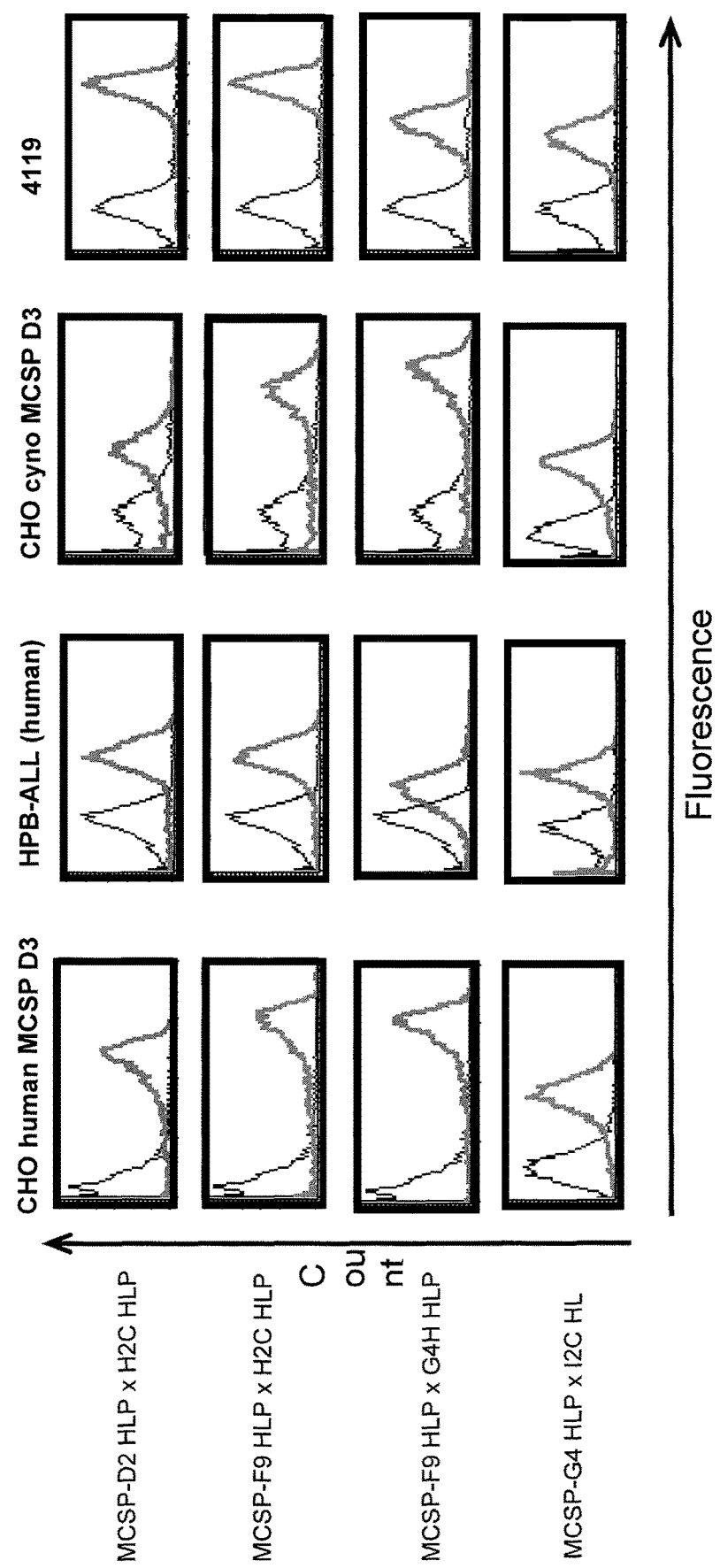
Figure 11:
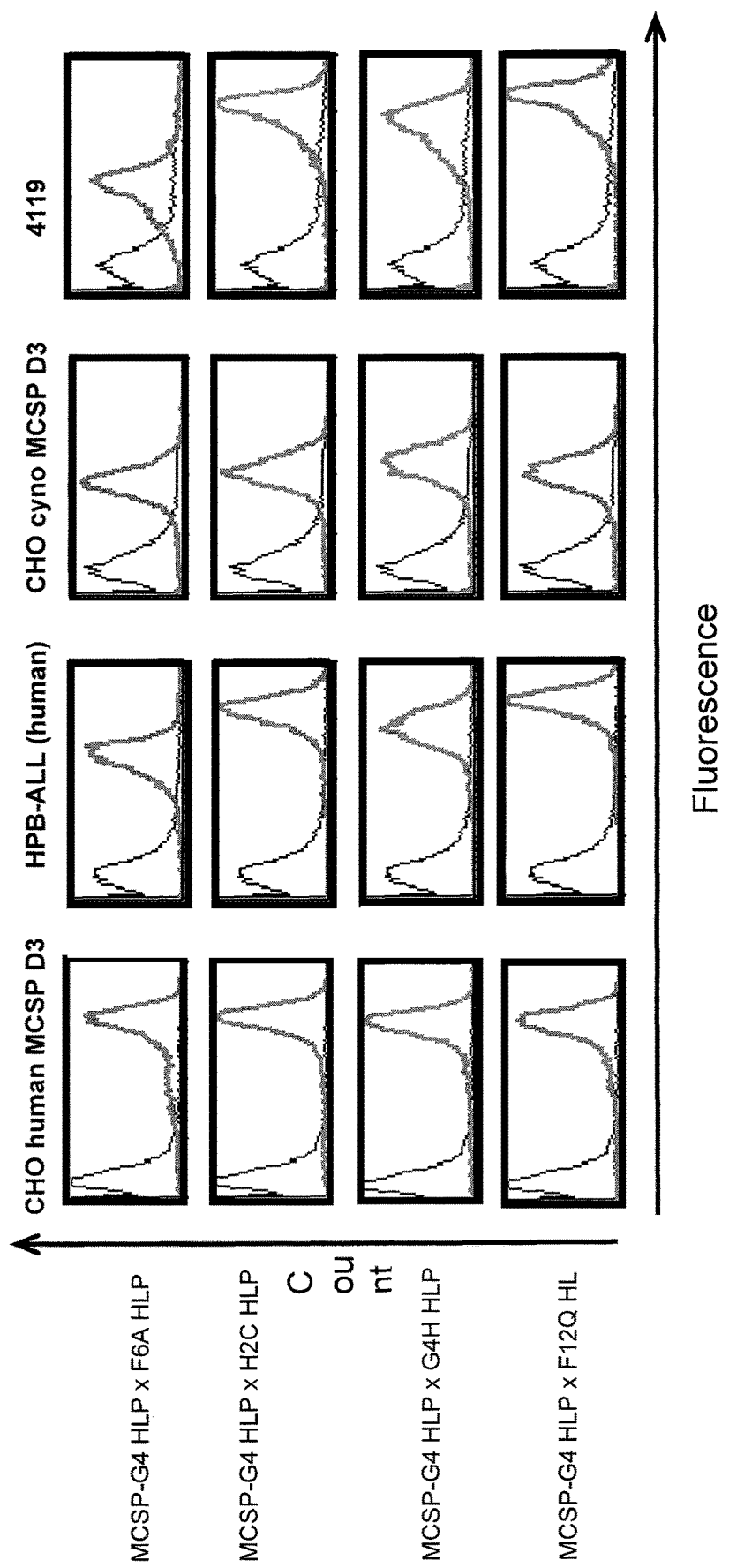
Figure 12:
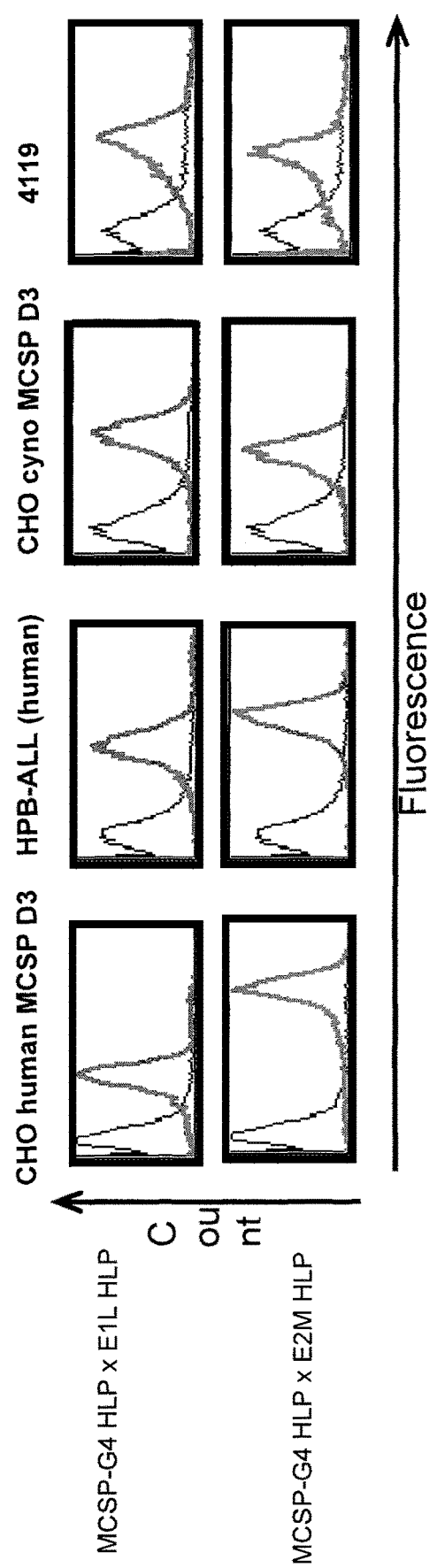

6.2. Binding of the Cross-Species Specific Anti-CD3 Binding Molecule H2C HLP to the Human CD3 Epsilon Chain with and without N-Terminal His6 Tag A chimeric IgG antibody with the binding specificity H2C HLP specific for CD3 epsilon was tested for binding to human CD3 epsilon with and without N-terminal His6 tag. Binding of the antibody to the EL4 cell lines transfected the His6-human CD3 epsilon and wild-type human CD3 epsilon respectively was tested by an FACS assay according to standard protocols. $2.5 \times 10^5$ cells of the transfectants were incubated with 50 µl of cell culture supernatant containing the chimeric IgG antibody or 50 µl of the respective control antibodies at 5 µg/ml in PBS with 2% FCS. As negative control an appropriate isotype control and as positive control for expression of the constructs the CD3 specific antibody UCHT-1 were used respectively. The binding of the antibodies was detected with a R-Phycoerythrin-conjugated affinity purified F(ab')2 fragment, goat anti-mouse IgG, Fc-gamma fragment specific, diluted 1:100 in PBS with 2% FCS (Jackson ImmunoResearch Europe Ltd., Newmarket, Suffolk, UK). Samples were measured on a FACSCalibur™ (BD biosciences, Heidelberg, Germany). Compared to the EL4 cell line transfected with wild-type human CD3 epsilon a clear loss of binding of the chimeric IgG with binding specificity H2C HLP to human-CD3 epsilon with an N-terminal His6 tag was detected. These results showed that a free N-terminus of CD3 epsilon is essential for binding of the cross-species specific anti-CD3 binding specificity H2C HLP to the human CD3 epsilon chain (FIG. 9).

7. Cloning and Expression of the C-Terminal, Transmembrane and Truncated Extracellular Domains of Human MCSP The coding sequence of the C-terminal, transmembrane and truncated extracellular domain of human MCSP (amino acids 1538-2322) was obtained by gene synthesis according to standard protocols (cDNA sequence and amino acid sequence of the recombinant construct for expression of the C-terminal, transmembrane and truncated extracellular domain of human MCSP (designated as human D3) are listed under SEQ ID NOs 250 and 249). The gene synthesis fragment was designed as to contain first a Kozak site to allow eukaryotic expression of the construct followed by the coding sequence of an 19 amino acid immunoglobulin leader peptide followed in frame by a FLAG tag, followed in frame by a sequence containing several restriction sites for cloning purposes and coding for a 9 amino acid artificial linker (SRTRSGSQL SEQ ID NO. 434), followed in frame by the coding sequence of the C-terminal, transmembrane and truncated extracellular domain of human MCSP and a stop codon. Restriction sites were introduced at the beginning and at the end of the DNA fragment. The restriction sites EcoRI at the 5' end and SalI at the 3' end were used in the following cloning procedures. The fragment was digested with EcoRI and SalI and cloned into pEF-DHFR (pEF-DHFR is described in Mack et al. Proc. Natl. Acad. Sci. USA 92 (1995) 7021-7025) following standard protocols. A sequence verified plasmid was used to transfect CHO/dhfr-cells (ATCC® No. CRL 9096). Cells were cultivated in RPMI 1640 with stabilized glutamine, supplemented with 10% FCS, 1% penicillin/streptomycin (all obtained from Biochrom AG Berlin, Germany) and nucleosides from a stock solution of cell culture grade reagents (Sigma-Aldrich Chemie GmbH, Taufkirchen, Germany) to a final concentration of 10 µg/ml Adenosine, 10 µg/ml Deoxyadenosine and 10 µg/ml Thymidine, in an incubator at 37° C., 95% humidity and 7% $CO_2$. Transfection was performed using the PolyFect™ Transfection Reagent (Qiagen GmbH, Hilden, Germany) and 5 µg of plasmid DNA according to the manufacturer's protocol. After cultivation for 24 hours cells were washed once with PBS and cultivated again in RPMI 1640 with stabilized glutamine and 1% penicillin/streptomycin. Thus the cell culture medium did not contain nucleosides and thereby selection was applied on the transfected cells. Approximately 14 days after transfection the outgrowth of resistant cells was observed. After an additional 7 to 14 days the transfectants were tested for expression of the construct by FACS analysis. $2.5 \times 10^5$ cells were incubated with 50 µl of an anti-Flag®-M2 antibody (Sigma-Aldrich Chemie GmbH, Taufkirchen, Germany) diluted to 5 µg/ml in PBS with 2% FCS. The binding of the antibody was detected with a R-Phycoerythrin-conjugated affinity purified F(ab')2 fragment, goat anti-mouse IgG, Fc-gamma fragment specific diluted 1:100 in PBS with 2% FCS (ImmunoResearch Europe Ltd., Newmarket, Suffolk, UK). The samples were measured on a FACSCalibur™ (BD biosciences, Heidelberg, Germany).

8. Cloning and Expression of the C-Terminal, Transmembrane and Truncated Extracellular Domains of Macaque MCSP The cDNA sequence of the C-terminal, transmembrane and truncated extracellular domains of macaque MCSP (designated as macaque D3) was obtained by a set of three PCRs on macaque skin cDNA (Cat No. C1534218-Cy-BC; BioCat GmbH, Heidelberg, Germany) using the following reaction conditions: 1 cycle at 94° C., 3 min., 40 cycles with 94° C. for 0.5 min., 52° C. for 0.5 min. and 72° C. for 1.75 min., terminal cycle of 72° C. for 3 min.. The following primers were used:

```
forward primer:
                                     (SEQ ID No. 361)
5'-GATCTGGTCTACACCATCGAGC-3' reverse primer:
                                     (SEQ ID No. 362)
5'-GGAGCTGCTGCTGGCTCAGTGAGG-3' forward primer:
                                     (SEQ ID No. 363)
5'-TTCCAGCTGAGCATGTCTGATGG-3' reverse primer:
                                     (SEQ ID No. 364)
5'-CGATCAGCATCTGGGCCCAGG-3' forward primer:
                                     (SEQ ID No. 365)
5'-GTGGAGCAGTTCACTCAGCAGGACC-3' reverse primer:
                                     (SEQ ID No. 366)
5'-GCCTTCACACCCAGTACTGGCC-3'
```

Those PCRs generated three overlapping fragments (A: 1-1329, B: 1229-2428, C: 1782-2547) which were isolated and sequenced according to standard protocols using the PCR primers and thereby provided a 2547 bp portion of the cDNA sequence of macaque MCSP (the cDNA sequence and amino acid sequence of this portion of macaque MCSP are listed under SEQ ID NOs 252 and 251) from 74 bp upstream of the coding sequence of the C-terminal domain to 121 bp downstream of the stop codon. Another PCR using the following reaction conditions: 1 cycle at 94° C. for 3 min, 10 cycles with 94° C. for 1 min, 52° C. for 1 min and 72° C. for 2.5 min, terminal cycle of 72° C. for 3 min was used to fuse the PCR products of the aforementioned reactions A and B. The following primers are used:

```
forward primer:
                                        (SEQ ID No. 367)
5'-tcccgtacgagatctggatcccaattggatggcggactcgtgctgt
tctcacacagagg-3' reverse primer:
                                        (SEQ ID No. 368)
5'-agtgggtcgactcacacccagtactggccattcttaagggcaggg-
3'
```

The primers for this PCR were designed to introduce restriction sites at the beginning and at the end of the cDNA fragment coding for the C-terminal, transmembrane and truncated extracellular domains of macaque MCSP. The introduced restriction sites MfeI at the 5' end and SalI at the 3' end, were used in the following cloning procedures. The PCR fragment was then cloned via MfeI and SalI into a Bluescript plasmid containing the EcoRI/MfeI fragment of the aforementioned plasmid pEF-DHFR (pEF-DHFR is described in Raum et al. Cancer Immunol Immunother 50 (2001) 141-150) by replacing the C-terminal, transmembrane and truncated extracellular domains of human MCSP. The gene synthesis fragment contained the coding sequences of the immunoglobulin leader peptide and the Flag tag as well as the artificial linker (SRTRSGSQL SEQ ID NO. 434) in frame to the 5' end of the cDNA fragment coding for the C-terminal, transmembrane and truncated extracellular domains of macaque MCSP. This vector was used to transfect CHO/dhfr-cells (ATCC® No. CRL 9096). Cells were cultivated in RPMI 1640 with stabilized glutamine supplemented with 10% FCS, 1% penicillin/streptomycin (all from Biochrom AG Berlin, Germany) and nucleosides from a stock solution of cell culture grade reagents (Sigma-Aldrich Chemie GmbH, Taufkirchen, Germany) to a final concentration of 10 µg/ml Adenosine, 10 µg/ml Deoxyadenosine and 10 µg/ml Thymidine, in an incubator at 37° C., 95% humidity and 7% $CO_2$. Transfection was performed with PolyFect™ Transfection Reagent (Qiagen GmbH, Hilden, Germany) and 5 µg of plasmid DNA according to the manufacturer's protocol. After cultivation for 24 hours cells were washed once with PBS and cultivated again in RPMI 1640 with stabilized glutamine and 1% penicillin/streptomycin. Thus the cell culture medium did not contain nucleosides and thereby selection was applied on the transfected cells. Approximately 14 days after transfection the outgrowth of resistant cells is observed. After an additional 7 to 14 days the transfectants were tested for expression of the recombinant construct via FACS. $2.5 \times 10^5$ cells were incubated with 50 µl of an anti-Flag®-M2 antibody (Sigma-Aldrich Chemie GmbH, Taufkirchen, Germany) diluted to 5 µg/ml in PBS with 2% FCS. Bound antibody was detected with a R-Phycoerythrin-conjugated affinity purified F(ab')2 fragment, goat anti-mouse IgG, Fc-gamma fragment specific, diluted 1:100 in PBS with 2% FCS (Jackson ImmunoResearch Europe Ltd., Newmarket, Suffolk, UK). Samples were measured on a FACSCalibur™ (BD biosciences, Heidelberg, Germany).

9. Generation and Characterisation of MCSP and CD3 Cross-Species Specific Bispecific Single Chain Molecules Bispecific single chain antibody molecules each comprising a binding domain cross-species specific for human and non-chimpanzee primate CD3 epsilon as well as a binding domain cross-species-specific for human and non-chimpanzee primate MCSP, are designed as set out in the following Table 1:

TABLE 1

Formats of MCSP and CD3 cross-species specific bispecific single chain antibodies

| SEQ ID (nucl/prot) | Formats of protein constructs (N → C) |
|---|---|
| 190/189 | MCSP-G4 HL x H2C HL |
| 192/191 | MCSP-G4 HL x F12Q HL |
| 194/193 | MCSP-G4 HL x I2C HL |
| 196/195 | MCSP-G4 HLP x F6A HLP |
| 198/197 | MCSP-G4 HLP x H2C HLP |
| 202/201 | MCSP-G4 HLP x G4H HLP |
| 206/205 | MCSP-G4 HLP x E1L HLP |
| 208/207 | MCSP-G4 HLP x E2M HLP |
| 212/211 | MCSP-G4 HLP x F12Q HL |
| 214/213 | MCSP-G4 HLP x I2C HL |
| 216/215 | MCSP-D2 HL x H2C HL |
| 218/217 | MCSP-D2 HL x F12Q HL |
| 220/219 | MCSP-D2 HL x I2C HL |
| 222/221 | MCSP-D2 HLP x H2C HLP |
| 224/223 | MCSP-F9 HL x H2C HL |
| 226/225 | MCSP-F9 HLP x H2C HLP |
| 228/227 | MCSP-F9 HLP x G4H HLP |
| 318/317 | MCSP-A9 HL x H2C HL |
| 320/319 | MCSP-A9 HL x F12Q HL |
| 322/321 | MCSP-A9 HL x I2C HL |
| 324/323 | MCSP-C8 HL x I2C HL |
| 328/327 | MCSP-B7 HL x I2C HL |
| 326/325 | MCSP-B8 HL x I2C HL |
| 330/329 | MCSP-G8 HL x I2C HL |
| 332/331 | MCSP-D5 HL x I2C HL |
| 334/333 | MCSP-F7 HL x I2C HL |
| 336/335 | MCSP-G5 HL x I2C HL |
| 338/337 | MCSP-F8 HL x I2C HL |
| 340/339 | MCSP-G10 HL x I2C HL |

The aforementioned constructs containing the variable heavy-chain (VH) and variable light-chain (VL) domains cross-species specific for human and macaque MCSP D3 and the VH and VL domains cross-species specific for human and macaque CD3 were obtained by gene synthesis. The gene synthesis fragments were designed as to contain first a Kozak site for eukaryotic expression of the construct, followed by a 19 amino acid immunoglobulin leader peptide, followed in frame by the coding sequence of the respective bispecific single chain antibody molecule, followed in frame by the coding sequence of a histidinee-tag and a stop codon. The gene synthesis fragment was also designed as to introduce suitable N- and C-terminal restriction sites. The gene synthesis fragment was cloned via these restriction sites into a plasmid designated pEF-DHFR (pEF-DHFR is described in Raum et al. Cancer Immunol Immunother 50 (2001) 141-150) according to standard protocols (Sambrook, Molecular Cloning; A Laboratory Manual, 3rd edition, Cold Spring Harbour Laboratory Press, Cold Spring Harbour, New York (2001)). The constructs were transfected stably or transiently into DHFR-deficient CHO-cells (ATCC® No. CRL 9096) by electroporation or alternatively into HEK 293 (human embryonal kidney cells, ATCC® Number: CRL-1573) in a transient manner according to standard protocols.

Eukaryotic protein expression in DHFR deficient CHO cells was performed as described by Kaufmann R. J. (1990) Methods Enzymol. 185, 537-566. Gene amplification of the constructs was induced by addition of increasing concentrations of methothrexate (MTX) up to final concentrations of 20 nM MTX. After two passages of stationary culture the cells were grown in roller bottles with nucleoside-free HyQ PF CHO™ liquid soy medium (with 4.0 mM L-Glutamine with 0.1% Pluronic F—68; HyClone) for 7 days before harvest. The cells were removed by centrifugation and the supernatant containing the expressed protein is stored at −20° C.

Äkta® Explorer System (GE Health Systems) and Unicorn® Software were used for chromatography. Immobilized metal affinity chromatography ("IMAC") was performed using a Fractogel EMD Chelate® (Merck) which was loaded with $ZnCl_2$ according to the protocol provided by the manufacturer. The column was equilibrated with buffer A (20 mM sodium phosphate buffer pH 7.2, 0.1 M NaCl) and the cell culture supernatant (500 ml) was applied to the column (10 ml) at a flow rate of 3 ml/min. The column was washed with buffer A to remove unbound sample. Bound protein was eluted using a two step gradient of buffer B (20 mM sodium phosphate buffer pH 7.2, 0.1 M NaCl, 0.5 M Imidazole) according to the following:

Step 1: 20% buffer B in 6 column volumes
Step 2: 100% buffer B in 6 column volumes Eluted protein fractions from step 2 were pooled for further purification. All chemicals are of research grade and purchased from Sigma (Deisenhofen) or Merck (Darmstadt).

Gel filtration chromatography was performed on a HiLoad 16/60 Superdex® 200 prep grade column (GE/Amersham) equilibrated with Equi-buffer (25 mM Citrate, 200 mM Lysine, 5% Glycerol, pH 7.2). Eluted protein samples (flow rate 1 ml/min) were subjected to standard SDS-PAGE and Western Blot for detection. Prior to purification, the column was calibrated for molecular weight determination (molecular weight marker kit, Sigma MW GF-200). Protein concentrations were determined using OD280 nm.

Purified bispecific single chain antibody protein was analyzed in SDS PAGE under reducing conditions performed with pre-cast 4-12% Bis Tris gels (Invitrogen). Sample preparation and application were performed according to the protocol provided by the manufacturer. The molecular weight was determined with MultiMark® protein standard (Invitrogen). The gel was stained with colloidal Coomassie (Invitrogen protocol). The purity of the isolated protein is >95% as determined by SDS-PAGE. The bispecific single chain antibody has a molecular weight of about 52 kDa under native conditions as determined by gel filtration in phosphate buffered saline (PBS). All constructs were purified according to this method.

Western Blot was performed using an Optitran® BA-S83 membrane and the Invitrogen Blot Module according to the protocol provided by the manufacturer. For detection of the bispecific single chain antibody protein antibodies an anti-His Tag antibody was used (Penta His, Qiagen). A Goat-anti-mouse Ig antibody labeled with alkaline phosphatase (AP) (Sigma) was used as secondary antibody and BCIP/NBT (Sigma) as substrate. A single band was detected at 52 kD corresponding to the purified bispecific single chain antibody.

Alternatively, constructs were transiently expressed in DHFR deficient CHO cells. In brief, $4\times10^5$ cells per construct were cultivated in 3 ml RPMI 1640 all medium with stabilized glutamine supplemented with 10% fetal calf serum, 1% penicillin/streptomycin and nucleosides from a stock solution of cell culture grade reagents (Sigma-Aldrich Chemie GmbH, Taufkirchen, Germany) to a final concentration of 10 µg/ml Adenosine, 10 µg/ml Deoxyadenosine and 10 µg/ml Thymidine, in an incubator at 37° C., 95% humidity and 7% CO2 one day before transfection. Transfection was performed with Fugene® 6 Transfection Reagent (Roche, #11815091001) according to the manufacturer's protocol. 94 µl OptiMEM™ medium (Invitrogen) and 6 µl Fugene® 6 are mixed and incubated for 5 minutes at room temperature. Subsequently, 1.5 µg DNA per construct were added, mixed and incubated for 15 minutes at room temperature. Meanwhile, the DHFR deficient CHO cells were washed with 1×PBS and resuspended in 1.5 ml RPMI 1640 all medium. The transfection mix was diluted with 600 µl RPMI 1640 all medium, added to the cells and incubated overnight at 37° C., 95% humidity and 7% CO2. The day after transfection the incubation volume of each approach was extended to 5 ml RPMI 1640 all medium. Supernatant was harvested after 3 days of incubation.

10. Flow Cytometric Binding Analysis of the MCSP and CD3 Cross-Species Specific Bispecific Antibodies In order to test the functionality of the cross-species specific bispecific antibody constructs regarding the capability to bind to human and macaque MCSP D3 and CD3, respectively, a FACS analysis was performed. For this purpose CHO cells transfected with human MCSP D3 (as described in Example 7) and the human CD3 positive T cell leukemia cell line HPB-ALL (DSMZ, Braunschweig, ACC483) were used to test the binding to human antigens. The binding reactivity to macaque antigens was tested by using the generated macaque MCSP D3 transfectant (described in Example 8) and a macaque T cell line 4119LnPx (kindly provided by Prof. Fickenscher, Hygiene Institute, Virology, Erlangen-Nuernberg; published in Knappe A, et al., and Fickenscher H., Blood 2000, 95, 3256-61). 200.000 cells of the respective cell lines were incubated for 30 min on ice with 50 µl of the purified protein of the cross-species specific bispecific antibody constructs (2 µg/ml) or cell culture supernatant of transfected cells expressing the cross-species specific bispecific antibody constructs. The cells were washed twice in PBS with 2% FCS and binding of the construct was detected with a murine anti-His antibody (Penta His antibody; Qiagen; diluted 1:20 in 50 µl PBS with 2% FCS). After washing, bound anti-His antibodies were detected with an Fc gamma-specific antibody (Dianova) conjugated to phycoerythrin, diluted 1:100 in PBS with 2% FCS. Supernatant of untransfected CHO cells was used as negative control for binding to the T cell lines. A single chain construct with irrelevant target specificity was used as negative control for binding to the MCSP-D3 transfected CHO cells.

Flow cytometry was performed on a FACSCalibur™ apparatus; the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

The bispecific binding of the single chain molecules listed above, which are cross-species specific for MCSP D3 and cross-species specific for human and macaque CD3 was clearly detectable as shown in FIGS. 10, 11, 12 and 39A-39-L In the FACS analysis all constructs showed binding to CD3 and MCSP D3 as compared to the respective negative controls. Cross-species specificity of the bispecific antibodies to human and macaque CD3 and MCSP D3 antigens was demonstrated.

11. Bioactivity of MCSP and CD3 Cross-Species Specific Bispecific Single Chain Antibodies Bioactivity of the generated bispecific single chain antibodies was analyzed by chromium 51 ($^{51}$Cr) release in vitro cytotoxicity assays using the MCSP D3 positive cell lines described in Examples 7 and 8. As effector cells stimulated human CD4/CD56 depleted PBMC, stimulated human PBMC or the macaque T cell line 4119LnPx are used as specified in the respective figures.

Generation of the stimulated CD4/CD56 depleted PBMC was performed as follows: Coating of a Petri dish (145 mm diameter, Greiner bio-one GmbH, Kremsmünster) was carried out with a commercially available anti-CD3 specific antibody (e.g. OKT3, Othoclone) in a final concentration of 1 µg/ml for 1 hour at 37° C. Unbound protein was removed by one washing step with PBS. The fresh PBMC were isolated from peripheral blood (30-50 ml human blood) by Ficoll gradient centrifugation according to standard protocols. 3-5×10$^7$ PBMC were added to the precoated petri dish in 120 ml of RPMI 1640 with stabilized glutamine/10% FCS/IL-2 20 U/ml (Proleukin®, Chiron) and stimulated for 2 days. On the third day the cells were collected and washed once with RPMI 1640. IL-2 was added to a final concentration of 20 U/ml and the cells were cultivated again for one day in the same cell culture medium as above. By depletion of CD4+ T cells and CD56+ NK cells according to standard protocols CD8+ cytotoxic T lymphocytes (CTLs) were enriched.

Target cells were washed twice with PBS and labelled with 11.1 MBq $^{51}$Cr in a final volume of 100 µl RPMI with 50% FCS for 45 minutes at 37° C. Subsequently the labelled target cells were washed 3 times with 5 ml RPMI and then used in the cytotoxicity assay. The assay was performed in a 96 well plate in a total volume of 250 µl supplemented RPMI (as above) with an E:T ratio 10:1. 1 µg/ml of the cross-species specific bispecific single chain antibody molecules and 20 threefold dilutions thereof were applied. If using supernatant containing the cross-species specific bispecific single chain antibody molecules, 21 two- and 20 threefold dilutions thereof were applied for the macaque and the human cytotoxicity assay, respectively. The assay time was 18 hours and cytotoxicity was measured as relative values of released chromium in the supernatant related to the difference of maximum lysis (addition of Triton®-X) and spontaneous lysis (without effector cells). All measurements were done in quadruplicates. Measurement of chromium activity in the supernatants was performed with a Wizard 3" (Wizard$^3$®) gamma counter (Perkin Elmer Life Sciences GmbH, Köln, Germany). Analysis of the experimental data was performed with Prism 4 for Windows (version 4.02, GraphPad Software Inc., San Diego, California, USA). Sigmoidal dose response curves typically have $R^2$ values >0.90 as determined by the software. EC5C values calculated by the analysis program were used for comparison of bioactivity.

As shown in FIGS. 13 to 17 and 40A-40D, all of the generated cross-species specific bispecific single chain antibody constructs demonstrate cytotoxic activity against human MCSP D3 positive target cells elicited by stimulated human CD4/CD56 depleted PBMC or stimulated PBMC and against macaque MCSP D3 positive target cells elicited by the macaque T cell line 4119LnPx.

12. Plasma Stability of MCSP and CD3 Cross-Species Specific Bispecific Single Chain Antibodies Stability of the generated bispecific single chain antibodies in human plasma was analyzed by incubation of the bispecific single chain antibodies in 50% human Plasma at 37° C. and 4° C. for 24 hours and subsequent testing of bioactivity. Bioactivity was studied in a chromium 51 ($^{51}$Cr) release in vitro cytotoxicity assay using a MCSP positive CHO cell line (expressing MCSP as cloned according to example 14 or 15) as target and stimulated human CD8 positive T cells as effector cells.

$EC_{50}$ values calculated by the analysis program as described above were used for comparison of bioactivity of bispecific single chain antibodies incubated with 50% human plasma for 24 hours at 37° C. and 4° C. respectively with bispecific single chain antibodies without addition of plasma or mixed with the same amount of plasma immediately prior to the assay.

Figure 18B:
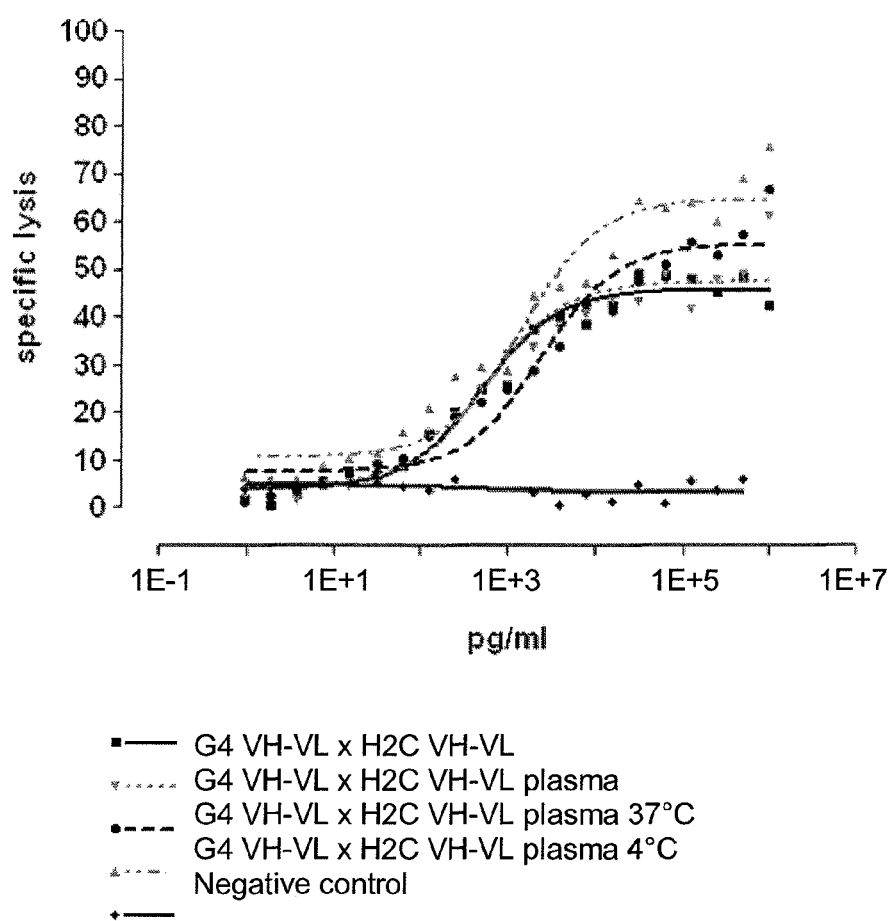
Figure 18C:
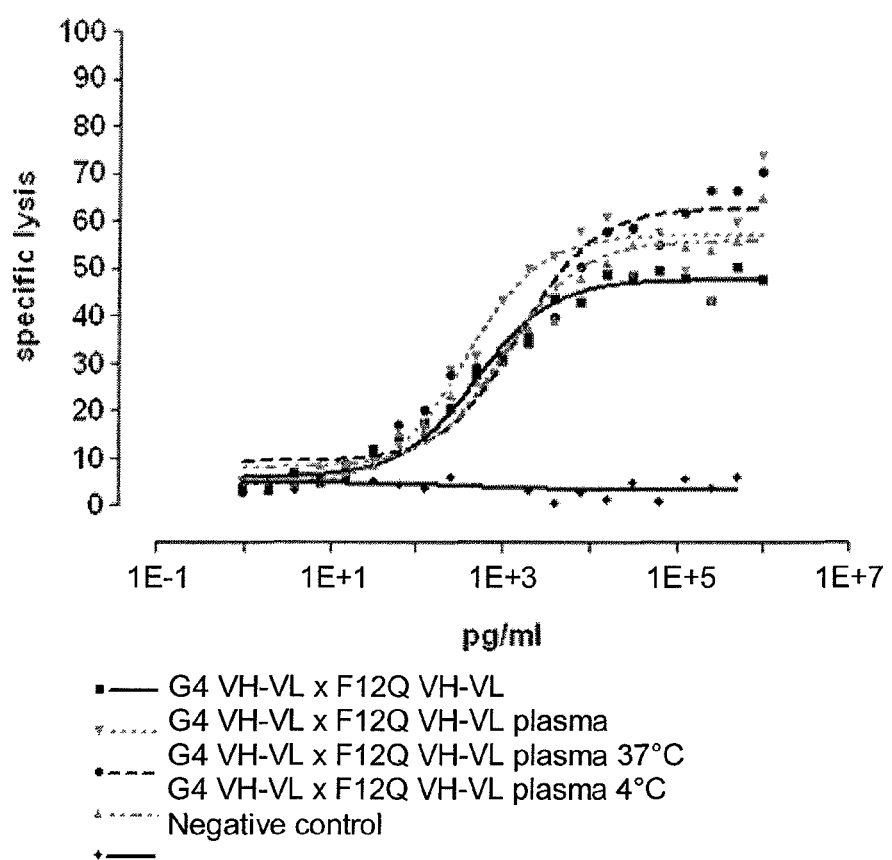

As shown in FIGS. 18A-18C and Table 2 the bioactivity of the G4 H-L×I2C H-L, G4 H-L×H2C H-L and G4 H-L× F12Q H-L bispecific antibodies was not significantly reduced as compared with the controls without the addition of plasma or with addition of plasma immediately before testing of bioactivity.

TABLE 2

| | bioactivity of the bispecific antibodies without or with the addition of Plasma | | | |
|---|---|---|---|---|
| Construct | Without plasma | With plasma | Plasma 37° C. | Plasma 4° C. |
| G4 H-L x I2C H-L | 300 | 796 | 902 | 867 |
| G4 H-L x H2C H-L | 496 | 575 | 2363 | 1449 |
| G4 H-L x F12Q H-L | 493 | 358 | 1521 | 1040 |

Figure 21:
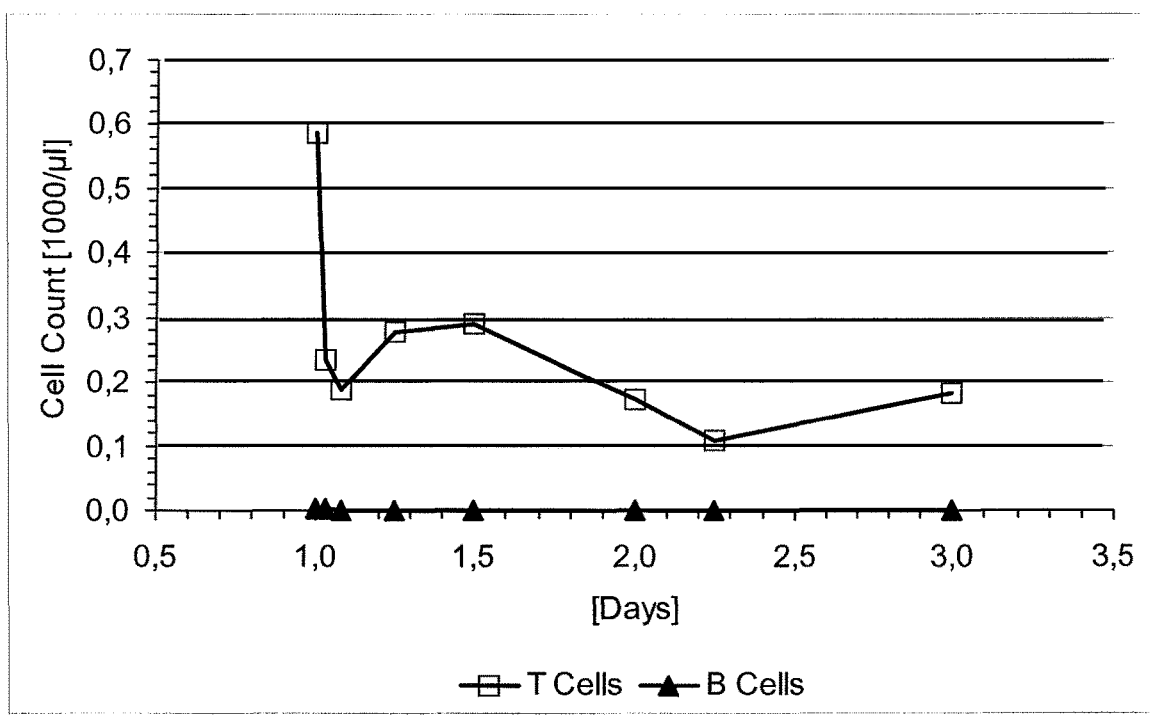

13. Redistribution of Circulating T Cells in the Absence of Circulating Target Cells by First Exposure to CD3 Binding Molecules Directed at Conventional i.e. Context Dependent CD3 Epitopes is a Major Risk Factor for Adverse Events Related to the Initiation of Treatment T Cell Redistribution in Patients with B-Cell Non-Hodgkin-Lymphoma (B-NHL) Following Initiation of Treatment with the Conventional CD3 Binding Molecule A conventional CD19×CD3 binding molecules is a CD3 binding molecule of the bispecific tandem scFv format (Loffler (2000, Blood, Volume 95, Number 6) or WO 99/54440). It consists of two different binding portions directed at (i) CD19 on the surface of normal and malignant human B cells and (ii) CD3 on human T cells. By cross-linking CD3 on T cells with CD19 on B cells, this construct triggers the redirected lysis of normal and malignant B cells by the cytotoxic activity of T cells. The CD3 epitope recognized by such a conventional CD3 binding molecule is localized on the CD3 epsilon chain, where it only takes the correct conformation if it is embedded within the rest of the epsilon chain and held in the right position by heterodimerization of the epsilon chain with either the CD3 gamma or delta chain. Interaction of this highly context dependent epitope with a conventional CD3 binding molecule (see e.g. Loffler (2000, Blood, Volume 95, Number 6) or WO 99/54440)—even when it occurs in a purely monovalent fashion and without any crosslinking—can induce an allosteric change in the conformation of CD3 leading to the exposure of an otherwise hidden proline-rich region within the cytoplasmic domain of CD3 epsilon. Once exposed, the proline-rich region can recruit the signal transduction molecule Nck2, which is capable of triggering further intracellular signals. Although this is not sufficient for full T cell activation, which definitely requires crosslinking of several CD3 molecules on the T cell surface, e.g. by crosslinking of several anti-CD3 molecules bound to several CD3 molecules on a T cell by several CD19 molecules on the surface of a B cell, pure monovalent interaction of conventional CD3 binding molecules to their context dependent epitope on CD3 epsilon is still not inert for T cells in terms of signalling. Without being bound by theory, monovalent conventional CD3 binding molecules (known in the art) may induce some T cell reactions when infused into humans even in those cases where no circulating target cells are available for CD3 crosslinking. An important T cell reaction to the intravenous infusion of monovalent conventional CD19×CD3 binding molecule into B-NHL patients who have essentially no circulating CD19-positive B cells is the redistribution of T cells after start of treatment. It has been found in a phase I clinical trial that this T cell reaction occurs during the starting phase of intravenous CD19×CD3 binding molecule infusion in all individuals without circulating CD19-positive target B cells essentially independent of the CD19×CD3 binding molecule dose (FIG. 19). However, sudden increases in CD19×CD3 binding molecule exposure have been found to trigger virtually the same redistributional T cell reaction in these patients as the initial exposure of T cells to CD19×CD3 binding molecule at treatment start (FIG. 20 A) and even gradual increases in CD19×CD3 binding molecule exposure still can have redistributional effects on circulating T cells (FIG. 21). Moreover, it has been found that this essentially dose-independent redistributional T cell reaction in the absence of circulating target cells as triggered by conventional CD3 binding molecules like the CD19×CD3 binding molecule (e.g. disclosed in WO 99/54440) in 100% of all treated individuals is a major risk factor for adverse events related to the initiation of treatment.

According to the study protocol, patients with relapsed histologically confirmed indolent B-cell Non-Hodgkin-Lymphoma (B-NHL) including mantle cell lymphoma were recruited in an open-label, multi-center phase I interpatient dose-escalation trial. The study protocol was approved by the independent ethics committees of all participating centers and sent for notification to the responsible regulatory authority. Measurable disease (at least one lesion >1.5 cm) as documented by CT scan was required for inclusion in the study. Patients received conventional CD19×CD3 binding molecule by continuous intravenous infusion with a portable minipump system over four weeks at constant flow rate (i.e. dose level). Patients were hospitalized during the first two weeks of treatment before they were released from the hospital and continued treatment at home. Patients without evidence of disease progression after four weeks were offered to continue treatment for further four weeks. So far six different dose levels were tested without reaching a maximum tolerated dose (MTD): 0.5, 1.5, 5, 15, 30 and 60 $\mu g/m^2/24$ h. Cohorts consisted of three patients each if no adverse events defined by the study protocol as DLT (dose limiting toxicity) were observed. In case of one DLT among the first three patients the cohort was expanded to six patients, which—in the absence of a second DLT—allowed further dose escalation. Accordingly, dose levels without DLT in cohorts with 3 patients or with one DLT in cohorts with 6 patients were regarded as safe. Study treatment was stopped in all patients who developed a DLT. At 15 and 30 $\mu g/m^2/24$ h different modes of treatment initiation during the first 24 h were tested in several additional cohorts: (i) Stepwise increase after 5 $\mu g/m^2/24$ h for the first 24 h to 15 $\mu g/m^2/24$ h maintenance dose (patient cohort 15-step), (ii) even continuous increase of flow-rate from almost zero to 15 or 30 $\mu g/m^2/24$ h (patient cohorts 15-ramp and 30-ramp) and (iii) start with the maintenance dose from the very beginning (patient cohorts 15-flat, 30-flat and 60-flat). Patient cohorts at dose levels 0.5, 1.5 and 5 $\mu g/m^2/24$ h were all started with the maintenance dose from the very beginning (i.e. flat initiation).

Time courses of absolute B- and T-cell counts in peripheral blood were determined by four color FACS analysis as follows:

Collection of Blood Samples and Routine Analysis

In patient cohorts 15-ramp, 15-flat, 30-ramp, 30-flat and 60-flat blood samples (6 ml) were obtained before and 0.75, 2, 6, 12, 24, 30, 48 hours after start of CD19×CD3 binding molecule (as disclosed in WO 99/54440) infusion as well as on treatment days 8, 15, 17, 22, 24, 29, 36, 43, 50, 57 and 4 weeks after end of conventional CD19×CD3 binding molecule infusion using EDTA-containing Vacutainer™ tubes (Becton Dickinson) which were shipped for analysis at 4° C. In patient cohorts 15-step blood samples (6 ml) were obtained before and 6, 24, 30, 48 hours after start of CD19×CD3 binding molecule infusion as well as on treatment days 8, 15, 22, 29, 36, 43, 50, 57 and 4 weeks after end of CD19×CD3 binding molecule infusion. At dose levels 0.5, 1.5 and 5 $\mu g/m^2/24$ h blood samples (6 ml) were obtained before and 6, 24, 48 hours after start of CD19×CD3 binding molecule infusion as well as on treatment days 8, 15, 22, 29, 36, 43, 50, 57 and 4 weeks after end of CD19×CD3 binding molecule infusion. In some cases slight variations of these time points occurred for operational reasons. FACS analysis of lymphocyte subpopulations was performed within 24-48 h after blood sample collection. Absolute numbers of leukocyte subpopulations in the blood samples were determined through differential blood analysis on a CoulterCounter™ (Coulter).

Isolation of PBMC from Blood Samples

PBMC (peripheral blood mononuclear cells) isolation was performed by an adapted Ficoll™ gradient separation protocol. Blood was transferred at room temperature into 10 ml Leucosep™ tubes (Greiner) pre-loaded with 3 ml Biocoll™ solution (Biochrom). Centrifugation was carried out in a swing-out rotor for 15 min at 1700×g and 22° C. without deceleration. The PBMC above the Biocoll™ layer were isolated, washed once with FACS buffer (PBS/2% FBS [Foetal Bovine Serum; Biochrom]), centrifuged and resuspended in FACS buffer. Centrifugation during all wash steps was carried out in a swing-out rotor for 4 min at 800×g and 4° C. If necessary, lysis of erythrocytes was performed by incubating the isolated PBMC in 3 ml erythrocyte lysis buffer (8.29 g $NH_4Cl$, 1.00 g $KHCO_3$, 0.037 g EDTA, ad 1.0 l $H_2O_{bidest}$, pH 7.5) for 5 min at room temperature followed by a washing step with FACS buffer.

Staining of PBMC with Fluorescence-Labeled Antibodies Against Cell Surface Molecules Monoclonal antibodies were obtained from Invitrogen ([1]Cat. No. MHCD1301, [2]Cat. No. MHCD1401), Dako ([5]Cat. No. C7224) or Becton Dickinson ([3]Cat. No. 555516, [4]Cat. No. 345766) used according to the manufacturers' recommendations. $5\times10^5$-$1\times10^6$ cells were stained with the following antibody combination: anti-CD13[1]/anti-CD14[2] (FITC)×anti-CD56[3] (PE)×anti-CD3[4] (PerCP)×anti-CD195 (APC). Cells were pelleted in V-shaped 96 well multititer plates (Greiner) and the supernatant was removed. Cell pellets were resuspended in a total volume of 100 µl containing the specific antibodies diluted in FACS buffer. Incubation was carried out in the dark for 30 min at 4° C.

Subsequently, samples were washed twice with FACS buffer and cell pellets were resuspended in FACS buffer for flowcytometric analysis.

Flowcytometric Detection of Stained Lymphocytes by FACS

Data collection was performed with a 4 color BD FACSCalibur™ (Becton Dickinson). For each measurement $1 \times 10^4$ cells of defined lymphocyte subpopulations were acquired. Statistical analysis was performed with the program CellQuest Pro™ (Becton Dickinson) to obtain lymphocyte subpopulation percentages and to classify cell surface molecule expression intensity. Subsequently, percentages of single lymphocyte subsets related to total lymphocytes (i.e. B plus T plus NK cells excluding any myeloid cells via CD13/14-staining) as determined by FACS were correlated with the lymphocyte count from the differential blood analysis to calculate absolute cell numbers of T cells ($CD3^+$, $CD56^-$, $CD13/14^-$) and B cells ($CD19^+$, $CD13/14^-$).

Figure 22:
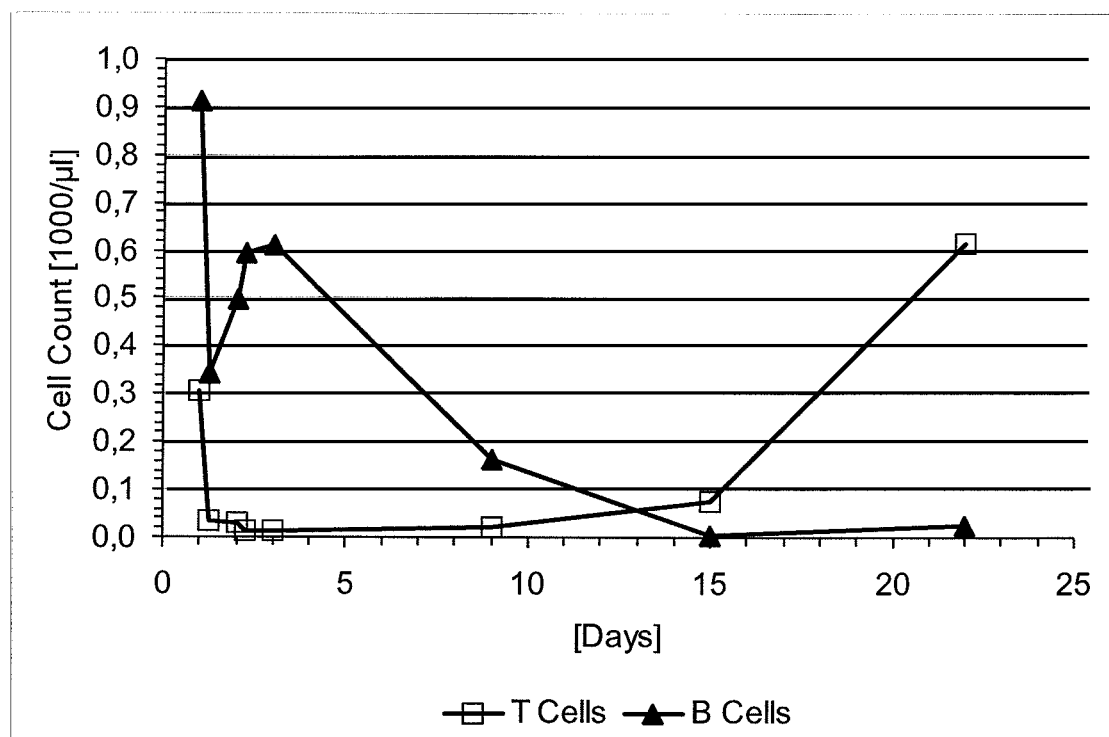
Figure 24:
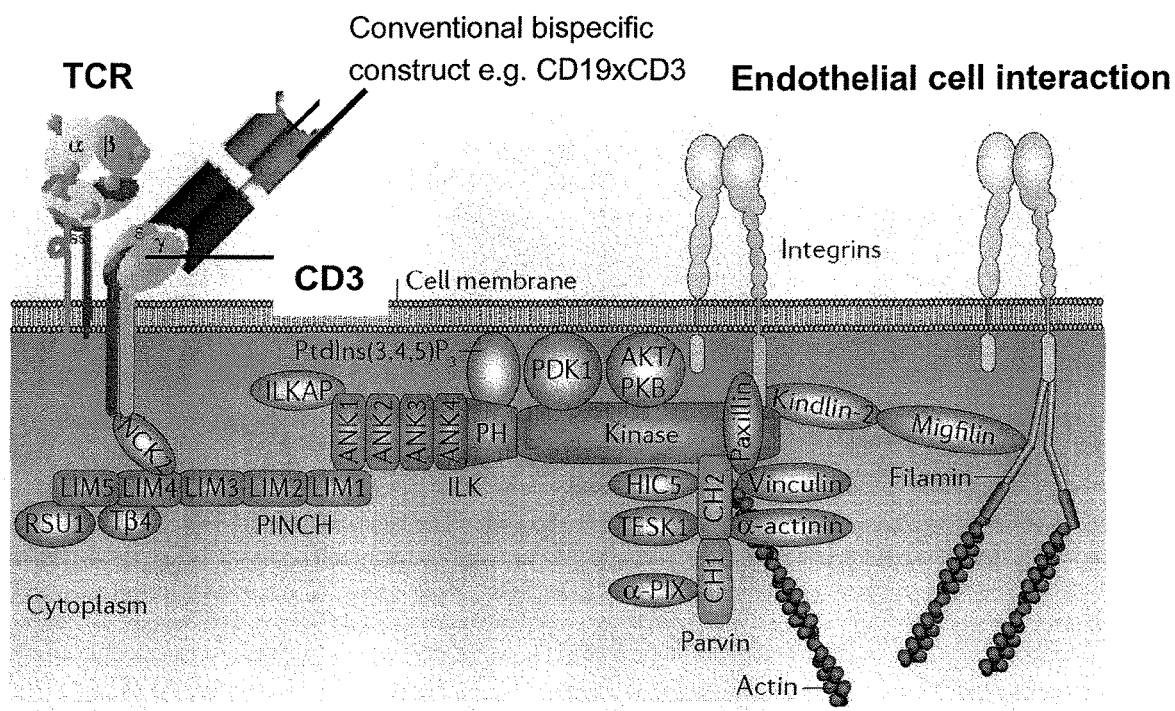

T cell redistribution during the starting phase of conventional CD19×CD3 binding molecule (e.g. disclosed in WO 99/54440) treatment in all those patients who had essentially no circulating CD19-positive B cells at treatment start is shown in (FIG. 19). For comparison, a representative example of T cell redistribution during the starting phase of CD19×CD3 binding molecule treatment in a patient with a significant number of circulating CD19-positive B cells is shown in FIG. 22.

In both cases (i.e. essentially no or many circulating B cells) circulating T cell counts rapidly decrease upon treatment start. However, in the absence of circulating B cells T cells tend to return into the circulating blood very early, while the return of T cells into the circulating blood of those patients who have a significant number of circulating B cells at treatment start is usually delayed until these circulating B cells are depleted. Thus, the T cell redistribution patterns mainly differ in the kinetics of T cell reappearance in the circulating blood.

Assessment of efficacy based on CT scan was carried out by central reference radiology after 4 weeks of treatment and in patients receiving additional 4 weeks also after 8 weeks of treatment plus in all cases four weeks after end of treatment. Disappearance and/or normalization in size of all known lesions (including an enlarged spleen) plus clearance of bone marrow from lymphoma cells in cases of bone marrow infiltration was counted as complete response (CR). Reduction by at least 50% from baseline of the sum of products of the two biggest diameters (SPD) of each predefined target lesion was defined as partial response (PR); a reduction by at least 25% was regarded a minimal response (MR). Progressive disease (PD) was defined as ≥50% increase of SPD from baseline. SPD deviations from baseline between +50% and −25% were regarded as stable disease (SD).

Patient demographics, doses received and clinical outcome in 34 patients are summarized in Table 3. Clinical anti-tumor activity of the CD19×CD3 binding molecule was clearly dose dependent: Consistent depletion of circulating CD19-positive B (lymphoma) cell from peripheral blood was observed from 5 µg/m²/24 h onwards. At 15 µg/m²/24 h and 30 µg/m²/24 h first objective clinical responses (PRs and CRs) were recorded as well as cases of partial and complete elimination of B lymphoma cells from infiltrated bone marrow. Finally, at 60 µg/m²/24 h the response rate increased to 100% (PRs and CRs) and bone marrow clearance from B lymphoma cells was complete in all evaluable cases.

The CD19×CD3 binding molecule was well tolerated by the majority of patients. Most frequent adverse events of grades 1-4 in 34 patients, regardless of causality are summarized in Table 4. CD19×CD3 binding molecule-related adverse events usually were transient and fully reversible. In particular, there were 2 patients (patients #19 and #24 in Table 3) essentially without circulating CD19-positive B cells whose treatment was stopped early because of CNS adverse events (lead symptoms: confusion and disorientation) related to repeated T cell redistribution during the starting phase of CD19×CD3 binding molecule infusion.

One of these patients (#19) was in cohort 15-step. He received 5 µg/m²/24 h CD19×CD3 binding molecule for the first 24 h followed by sudden increase to 15 µg/m²/24 h maintenance dose. The corresponding T cell redistribution pattern shows that circulating T cell counts rapidly decreased upon start of infusion at 5 µg/m²/24 h followed by early reappearance of T cells in the circulating blood essentially without circulating CD19-positive B cells. As a consequence, the peripheral T cell counts had fully recovered when the CD19×CD3 binding molecule dose was increased after 24 h from 5 to 15 µg/m²/24 h. Therefore the dose step could trigger a second episode of T cell redistribution as shown in FIG. 20 A. This repeated T cell redistribution was related with CNS side effects (lead symptoms: confusion and disorientation) in this patient, which led to the stop of infusion. The relationship between repeated T cell redistribution and such CNS adverse events was also observed in previous phase I clinical trials in B-NHL patients who received CD19×CD3 binding molecule (e.g. disclosed in WO 99/54440) as repeated bolus infusion for 2 to 4 hours each usually followed by 2 days of treatment free interval (FIG. 20 B). Every single bolus infusion triggered one episode of T cell redistribution consisting of a fast decrease in circulating T cell counts and T cell recovery prior to the next bolus infusion. In total, CNS adverse events related to repeated T cell redistribution were observed in 5 out of 21 patients. FIG. 20 B shows the representative example of one patient from the bolus infusion trials, who developed CNS symptoms after the third episode of T cell redistribution. Typically, patients with CNS adverse events in the bolus infusion trials also had low circulating B cell counts.

The second patient (#24) from the continuous infusion trial, whose treatment was stopped early because of CNS adverse events (lead symptoms: confusion and disorientation) related to repeated T cell redistribution during the starting phase of CD19×CD3 binding molecule infusion, was in cohort 15-flat. By mistake, this patient received an CD19×CD3 binding molecule infusion without additional HSA as required for stabilization of the drug. The resulting uneven drug flow triggered repeated episodes of T cell redistribution instead of only one (FIG. 23 A) with the consequence that the infusion had to be stopped because of developing CNS symptoms. Yet, when the same patient was restarted correctly with CD19×CD3 binding molecule solution containing additional HSA for drug stabilization (e.g. disclosed in WO 99/54440), no repeated T cell redistribution was observed and the patient did not again develop any CNS symptoms (FIG. 23 B). Because this patient also had essentially no circulating B cells, the circulating T cells could react with fast redistribution kinetics even to subtle changes in drug exposure as observed. The CNS adverse events related to T cell redistribution in patients who have essentially no circulating target cells can be explained by a transient increase of T cell adhesiveness to the endothelial cells followed by massive simultaneous adhesion of circulating T cells to the blood vessel walls with a consecutive drop of T cell numbers in the circulating blood as observed. The massive simultaneous attachment of T cells to the blood vessel walls can cause an increase in endothelial permeability and endothelial cell activation. The consequences of increased endothelial permeability are fluid shifts from the intravascular compartment into interstitial tissue compartments including the CNS interstitium. Endothelial cell activation by attached T cells can have procoagulatory effects (Monaco et al. J Leukoc Biol 71 (2002) 659-668) with possible disturbances in blood flow (including cerebral blood flow) particularly with regard to capillary microcirculation. Thus, CNS adverse events related to T cell redistribution in patients essentially without circulating target cells can be the consequence of capillary leak and/or disturbances in capillary microcirculation through adherence of T cells to endothelial cells. The endothelial stress caused by one episode of T cell redistribution is tolerated by the majority of patients, while the enhanced endothelial stress caused by repeated T cell redistribution frequently causes CNS adverse events. More than one episode of T cell redistribution may be less risky only in patients who have low baseline counts of circulating T cells. However, also the limited endothelial stress caused by one episode of T cell redistribution can cause CNS adverse events in rare cases of increased susceptibility for such events as observed in 1 out of 21 patients in the bolus infusion trials with the CD19×CD3 binding molecule.

Without being bound by theory, the transient increase of T cell adhesiveness to the endothelial cells in patients who have essentially no circulating target cells can be explained as T cell reaction to the monovalent interaction of a conventional CD3 binding molecule, like the CD19×CD3 binding molecule (e.g. WO 99/54440), to its context dependent epitope on CD3 epsilon resulting in an allosteric change in the conformation of CD3 followed by the recruitment of Nck2 to the cytoplasmic domain of CD3 epsilon as described above. As Nck2 is directly linked to integrins via PINCH and ILK (FIG. 28), recruitment of Nck2 to the cytoplasmic domain of CD3 epsilon following an allosteric change in the conformation of CD3 through binding of a conventional CD3 binding molecule, like the CD19×CD3 binding molecule, to its context dependent epitope on CD3 epsilon, can increase the adhesiveness of T cells to endothelial cells by transiently switching integrins on the T cell surface into their more adhesive isoform via inside-out-signalling.

TABLE 3

Patient demographics and clinical outcome

| Cohort | Patient | Age/Sex | Disease (Ann Arbor Classification) | Dose Level [mg/m$^2$/Day] | Clearance of Bone Marrow | Best Response* (CR Duration in Months or Weeks) |
|---|---|---|---|---|---|---|
| 1 | 1 | 71/m | IC, Binet C | 0.0005 | None | SD |
|  | 2 | 67/f | MCL, Stage IV/A/E | 0.0005 | n.d. | PD |
|  | 3 | 67/m | CLL, Stage IV/B/E | 0.0005 | n.d. | MR |
| 2 | 4 | 69/m | MCL, Stage IV/B | 0.0015 | n.i. | SD |
|  | 5 | 49/m | MCL, Stage IV/A/S | 0.0015 | n.d. | SD |
|  | 6 | 71/m | MCL, Stage IV/B/E | 0.0015 | n.i. | PD |
|  | 7 | 77/m | MCL, Stage IV/B/E/S | 0.0015 | n.i. | SD |
|  | 8 | 65/m | CLL, Stage IV/B/E/S | 0.0015 | n.d. | PD |
|  | 9 | 75/m | FL, Stage II/B | 0.0015 | n.i. | SD |
| 3 | 10 | 58/m | MCL, Stage III/B/S | 0.005 | n.i. | PD |
|  | 11 | 68/f | FL, Stage IV/B | 0.005 | n.d. | SD |
|  | 12 | 65/m | MCL, Stage III/A/E | 0.005 | n.i. | SD |
| 4$^a$ | 13 | 60/m | SLL, Stage IV/B/S | 0.015 | Complete | PR |
|  | 14 | 73/m | MCL, Stage II/A/E | 0.015 | n.i. | SD |
|  | 15 | 44/m | FL, Stage IV/B/E/S | 0.015 | Partial | PR |
|  | 16 | 61/m | FL, Stage IV/A/S | 0.015 | Complete | CR (7 mo) |
|  | 17 | 67/m | MZL, Stage IV/B/S | 0.015 | n.i. | n.e. |
|  | 18 | 64/m | FL, Stage | 0.015 | n.i. | PD |
|  | 19 | 75/m | MCL, Stage III/A | 0.015 | n.i. | n.e. |
|  | 20 | 65/f | FL; Stage III/A | 0.015 | n.i. | SD |
|  | 21 | 60/m | MCL, Stage IV/A/E | 0.015 | None | SD |
|  | 22 | 67/f | FL, Stage IV/B | 0.015 | Complete | MR |
|  | 23 | 67/m | DLBCL, Stage III/B | 0.015 | n.i. | n.e. |
|  | 24 | 65/f | FL, Stage IIIA | 0.015 | n.d. | SD |
|  | 25 | 74/f | WD, Stage IV/B | 0.015 | Partial | SD |

TABLE 3-continued

Patient demographics and clinical outcome

| Cohort | Patient | Age/Sex | Disease (Ann Arbor Classification) | Dose Level [mg/m²/Day] | Clearance of Bone Marrow | Best Response* (CR Duration in Months or Weeks) |
|---|---|---|---|---|---|---|
| 5 | 26 | 67/m | MCL, Stage IV/A | 0.03 | Complete | SD |
|   | 27 | 48/m | FL, Stage III/A | 0.03 | n.i. | PD |
|   | 28 | 58/m | MCL, Stage III/A | 0.03 | n.i. | CR (10 mo+) |
|   | 29 | 45/f | MCL, Stage IV/B | 0.03 | Partial | PD |
|   | 30 | 59/m | MZL, Stage III/A | 0.03 | n.i. | n.e. |
|   | 31 | 43/m | FL, Stage III/A | 0.03 | n.i. | MR |
| 6 | 32 | 72/m | MCL, Stage IV/A | 0.06 | Complete | PR |
|   | 33 | 55/m | MCL, Stage IV/B | 0.06 | Complete | CR (4 mo+) |
|   | 34 | 52/m | FL, Stage IV/A | 0.06 | n.i. | CR$^b$ (1 w+) |

*Centrally confirmed complete (CR) and partial (PR) responses by Cheson criteria in bold; MR, minimal response (≥25 to <50%); SD, stable disease; PD, progressive disease; duration from first documentation of response in parentheses; + denotes an ongoing response
$^a$Cohort 4 was expanded to study three different schedules of treatment initiation
$^b$PR after 8 weeks of treatment that turned into a CR after an additional treatment cycle of 4 weeks at the same dose following 7 weeks of treatment free interval
n.e.: not evaluable, because of treatment period <7 d
n.d.: not determined (infiltrated, but no second biopsy performed at end of treatment)
n.i.: not infiltrated at start of treatment

TABLE 4

Incidence of adverse events observed during treatment

| Adverse events regardless of relationship, occuring in ≥ 3 patients (N = 34) | Grade 1-4 N (%) | Grade 3-4 N (%) |
|---|---|---|
| Pyrexia | 22 (64.7) | 2 (5.9) |
| Leukopenia | 21 (61.8) | 11 (32.4) |
| Lymphopenia | 21 (61.8) | 21 (61.8) |
| Coagulopathy (increase in D-dimers) | 16 (47.1) | 6 (17.6) |
| Enzyme abnormality (AP, LDH, CRP) | 16 (47.1) | 10 (29.4) |
| Hepatic function abnormality (ALT, AST, GGT) | 16 (47.1) | 1 (2.9) |
| Anaemia | 13 (38.2) | 5 (14.7) |
| Chills | 13 (38.2) | 0 (0.0) |
| Headache | 12 (35.3) | 1 (2.9) |
| Hypokalaemia | 12 (35.3) | 2 (5.9) |
| Thrombocytopenia | 12 (35.3) | 6 (17.6) |
| Weight increased | 12 (35.3) | 0 (0.0) |
| Hyperglycaemia | 11 (32.4) | 2 (5.9) |
| Neutropenia | 11 (32.4) | 8 (23.5) |
| Haematuria | 10 (29.4) | 0 (0.0) |
| Oedema peripheral | 10 (29.4) | 2 (5.9) |
| Anorexia | 9 (26.5) | 1 (2.9) |
| Diarrhoea | 9 (26.5) | 0 (0.0) |
| Weight decreased | 9 (26.5) | 0 (0.0) |
| Fatigue | 8 (23.5) | 1 (2.9) |
| Proteinuria | 8 (23.5) | 0 (0.0) |
| Hypocalcaemia | 7 (20.6) | 2 (5.9) |
| Pancreatic enzyme abnormality | 7 (20.6) | 0 (0.0) |
| Cough | 6 (17.6) | 0 (0.0) |
| Dyspnoea | 6 (17.6) | 0 (0.0) |
| Back pain | 5 (14.7) | 0 (0.0) |
| Catheter site pain | 5 (14.7) | 0 (0.0) |
| Hyperbilirubinaemia | 5 (14.7) | 2 (5.9) |
| Hypoalbuminaemia | 5 (14.7) | 0 (0.0) |
| Hypogammaglobulinaemia | 5 (14.7) | 1 (2.9) |
| Hypoproteinaemia | 5 (14.7) | 0 (0.0) |
| Pleural effusion | 5 (14.7) | 1 (2.9) |
| Vomiting | 5 (14.7) | 0 (0.0) |
| Asthenia | 4 (11.8) | 1 (2.9) |
| Confusional state | 4 (11.8) | 0 (0.0) |
| Constipation | 4 (11.8) | 0 (0.0) |
| Dizziness | 4 (11.8) | 0 (0.0) |
| Hypertension | 4 (11.8) | 0 (0.0) |
| Hyponatraemia | 4 (11.8) | 2 (5.9) |
| Mucosal dryness | 4 (11.8) | 0 (0.0) |
| Muscle spasms | 4 (11.8) | 0 (0.0) |
| Nausea | 4 (11.8) | 0 (0.0) |
| Night sweats | 4 (11.8) | 0 (0.0) |
| Abdominal pain | 3 (8.8) | 1 (2.9) |
| Ascites | 3 (8.8) | 0 (0.0) |
| Hypercoagulation | 3 (8.8) | 0 (0.0) |
| Hyperhidrosis | 3 (8.8) | 0 (0.0) |
| Hypoglobulinaemia | 3 (8.8) | 0 (0.0) |
| Insomnia | 3 (8.8) | 0 (0.0) |
| Liver disorder | 3 (8.8) | 1 (2.9) |
| Nasopharyngitis | 3 (8.8) | 0 (0.0) |
| Pruritus | 3 (8.8) | 0 (0.0) |

Abbreviations used are: AE, adverse event; AP, alkaline phosphatase; LDH, lactate dehydrogenase; CRP, C-reactive protein; ALT, alanine transaminase; AST, aspartate transaminase; GGT, gamma-glutamyl transferase; AE data from the additional treatment cycle of patient 34 not yet included.

As explained above, conventional CD3 binding molecules (e.g. disclosed in WO 99/54440) capable of binding to a context-dependent epitope, though functional, lead to the undesired effect of T cell redistribution in patients causing CNS adverse events. In contrast, binding molecules of the present invention, by binding to the context-independent N-terminal 1-27 amino acids of the CD3 epsilon chain, do not lead to such T cell redistribution effects. As a consequence, the CD3 binding molecules of the invention are associated with a better safety profile compared to conventional CD3 binding molecules.

Figure 25:
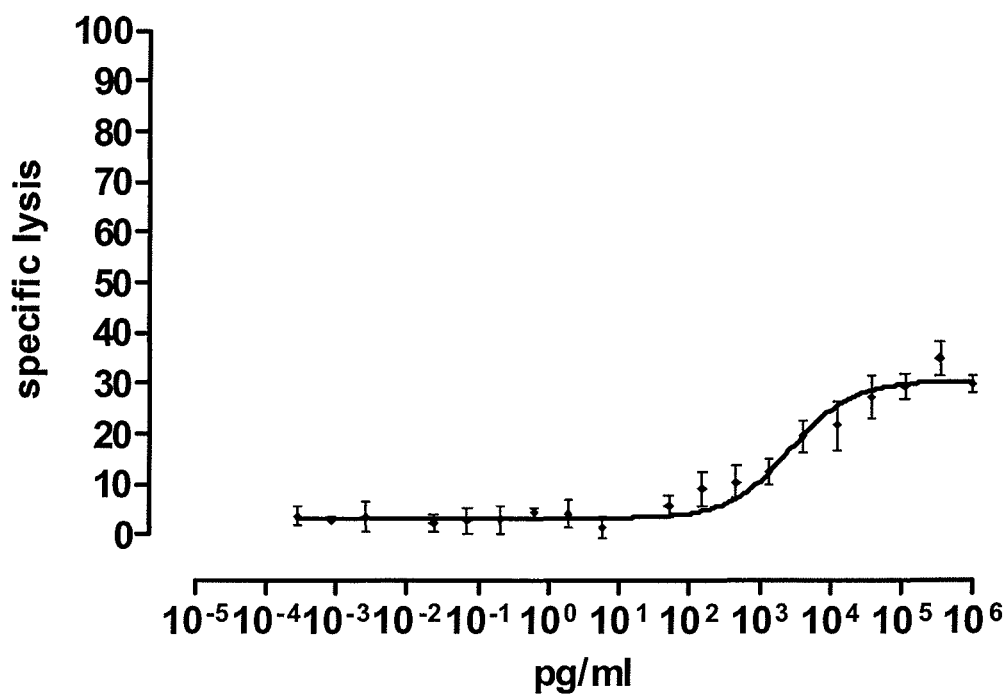

14. Bispecific CD3 Binding Molecules of the Invention Inducing T Cell Mediated Target Cell Lysis by Recognizing a Surface Target Antigen Deplete Target Antigen Positive Cells In Vivo A Bispecific CD3 Binding Molecule of the Invention Recognizing CD33 as Target Antigen Depletes CD33-Positive Circulating Monocytes from the Peripheral Blood of Cynomolgus Monkeys CD33-AF5 VH-VL×I2C VH-VL (amino acid sequence: SEQ ID NO. 267) was produced by expression in CHO cells using the coding nucleotide sequence SEQ ID NO. 268. The coding sequences of (i) an N-terminal immunoglobulin heavy chain leader comprising a start codon embedded within a Kozak consensus sequence and (ii) a C-terminal His6-tag followed by a stop codon were both attached in frame to the nucleotide sequence SEQ ID NO 268 prior to insertion of the resulting DNA-fragment as obtained by gene synthesis into the multiple cloning site of the expression vector pEF-DHFR (Raum et al. Cancer Immunol Immunother 50 (2001) 141-150). Stable transfection of DHFR-deficient CHO cells, selection for DHFR-positive transfectants secreting the CD3 binding molecule CD33-AF5 VH-VL×I2C VH-VL into the culture supernatant and gene amplification with methotrexat for increasing expression levels were carried out as described (Mack et al. Proc. Natl. Acad. Sci. USA 92 (1995) 7021-7025). Test material for treatment of cynomolgus monkeys was produced in a 20-liter fermenter. Protein purification from the harvest of 3 production runs was based on IMAC affinity chromatography targeting the C-terminal His6-tag of CD33-AF5 VH-VL×I2C VH-VL followed by preparative size exclusion chromatography (SEC). The total yield of final endotoxin-free test material was 60 mg. The analytical SEC-profile of CD33-AF5 VH-VL×I2C VH-VL for use in cynomolgus monkeys revealed that the test material almost exclusively consisted of monomer. The potency of the test material was measured in a cytotoxicity assay as described in example 16.5 using CHO cells transfected with cynomolgus CD33 as target cells and the macaque T cell line 4119LnPx as source of effector cells (FIG. 25). The concentration of CD33-AF5 VH-VL×I2C VH-VL required for half-maximal target cell lysis by the effector T cells (EC50) was determined to be 2.7 ng/ml.

Young (approx. 3 years old) adult cynomolgus monkeys (*Macaca fascicularis*) were treated by continuous intravenous infusion of CD3 binding molecule CD33-AF5 VH-VL×I2C VH-VL at different flow-rates (i.e. dose levels) to study depletion of circulating CD33-positive monocytes from the peripheral blood. This situation is equivalent to the treatment with the conventional CD3 binding molecule CD19×CD3 (specific for CD19 on B cells and CD3 on T cells) of those B-NHL patients, who have circulating CD19-positive target B cells (see e.g. WO99/54440). Depletion of circulating CD19-positive target B cells from the peripheral blood had turned out as a valid surrogate for the general clinical efficacy of the conventional CD3 binding molecule (CD19×CD3 as provided in WO99/54440) in patients with CD19-positive B-cell malignomas like B-NHL. Likewise, depletion of circulating CD33-positive monocytes from the peripheral blood is regarded as a valid surrogate of the general clinical efficacy of CD33-directed bispecific CD3 binding molecules of the invention like CD33-AF5 VH-VL×I2C VH-VL in patients with CD33-positive myeloid malignomas like AML (acute myeloid leukemia).

Continuous infusion was carried out according to the Swivel method as follows: The monkeys are catheterized via the vena *femoralis* into the vena cava caudalis using a vein catheter. The catheter is tunneled subcutaneously to the dorsal shoulder region and exteriorized at the caudal scapula. Then a tube is passed through a jacket and a protection spring. The jacket is fastened around the animal and the catheter, via the tube, is connected to an infusion pump.

Administration solution (1.25 M lysine, 0.1% TWEEN® 80, pH 7) without test material was infused continuously at 48 ml/24 h for 7 days prior to treatment start to allow acclimatization of the animals to the infusion conditions. Treatment was started by adding CD33-AF5 VH-VL×I2C VH-VL test material to the administration solution at the amount required for each individual dose level to be tested (i.e. flow rate of CD33-AF5 VH-VL×I2C VH-VL). The infusion reservoir was changed every day throughout the whole acclimatization and treatment phase. Planned treatment duration was 7 days except for the 120 µg/m$^2$/24 h dose level, where animals received 14 days of treatment.

Time courses of absolute counts in circulating T cells and CD33-positive monocytes were determined by 4- or 3-colour FACS analysis, respectively:

Collection of Blood Samples and Routine Analysis

Blood samples (1 ml) were obtained before and 0.75, 2, 6, 12, 24, 30, 48, 72 hours after start of continuous infusion with MCSP-G4 VH-VL×I2C VH-VL as well as after 7 and 14 days (and after 9 days at the 120 µg/m$^2$/24 h dose level) of treatment using EDTA-containing Vacutainer™ tubes (Becton Dickinson) which were shipped for analysis at 4° C. In some cases slight variations of these time points occurred for operational reasons. FACS analysis of lymphocyte subpopulations was performed within 24-48 h after blood sample collection. Absolute numbers of leukocyte subpopulations in the blood samples were determined through differential blood analysis in a routine veterinary lab.

Isolation of PBMC from Blood Samples

PBMC (peripheral blood mononuclear cells) isolation was performed by an adapted Ficoll™ gradient separation protocol. Blood was transferred at room temperature into 5 ml Falcon™ tubes pre-loaded with 1 ml Biocoll™ solution (Biochrom). Centrifugation was carried out in a swing-out rotor for 15 min at 1700×g and 22° C. without deceleration. The PBMC above the Biocoll™ layer were isolated, washed once with FACS buffer (PBS/2% FBS [Foetal Bovine Serum; Biochrom]), centrifuged and resuspended in FACS buffer. Centrifugation during all wash steps was carried out in a swing-out rotor for 4 min at 800×g and 4° C. If necessary, lysis of erythrocytes was performed by incubating the isolated PBMC in 3 ml erythrocyte lysis buffer (8.29 g NH$_4$Cl, 1.00 g KHCO$_3$, 0.037 g EDTA, ad 1.0 l H$_2$O$_{bidest}$, pH 7.5) for 5 min at room temperature followed by a washing step with FACS buffer.

Staining of PBMC with Fluorescence-Labeled Antibodies Against Cell Surface Molecules Monoclonal antibodies reactive with cynomolgus antigens were obtained from Becton Dickinson ([1]Cat. No. 345784, [2]Cat. No. 556647, [3]Cat. No. 552851, [6]Cat. No. 557710), Beckman Coulter ([4]Cat. No. IM2470) and Miltenyi ([5]Cat. No. 130-091-732) and used according to the manufacturers' recommendations. 5×10$^5$-1×10$^6$ cells were stained with the following antibody combinations: anti-CD14[1] (FITC)×anti-CD56[2] (PE)×anti-CD3[3] (PerCP)×anti-CD19[4] (APC) and anti-CD14[1] (FITC)×anti-CD33[5] (PE)×anti-CD16[6] (Alexa Fluor 647™). Cells were pelleted in V-shaped 96 well multititer plates (Greiner) and the supernatant was removed. Cell pellets were resuspended in a total volume of 100 μl containing the specific antibodies diluted in FACS buffer. Incubation was carried out in the dark for 30 min at 4° C. Subsequently, samples were washed twice with FACS buffer and cell pellets were resuspended in FACS buffer for flowcytometric analysis.

Flowcytometric Detection of Stained Lymphocytes by FACS

Data collection was performed with a 4 color BD FACSCalibur™ (Becton Dickinson). For each measurement $1 \times 10^4$ cells of defined lymphocyte subpopulations were acquired. Statistical analysis was performed with the program CellQuest Pro™ (Becton Dickinson) to obtain lymphocyte subpopulation percentages and to classify cell surface molecule expression intensity. Subsequently, percentages of single lymphocyte subsets related to total lymphocytes (i.e. B plus T plus NK cells excluding myeloid cells via CD14-staining) as determined by FACS were correlated with the lymphocyte count from the differential blood analysis to calculate absolute cell numbers of T cells ($CD3^+$, $CD56^-$, $CD14^-$). Absolute numbers of CD33-positive monocytes were calculated by multiplying the monocyte counts from the differential blood analysis with the corresponding ratios of CD33-positive monocytes ($CD33^+$, $CD14^+$) to all monocytes ($CD14^+$) as determined by FACS.

Figure 26:
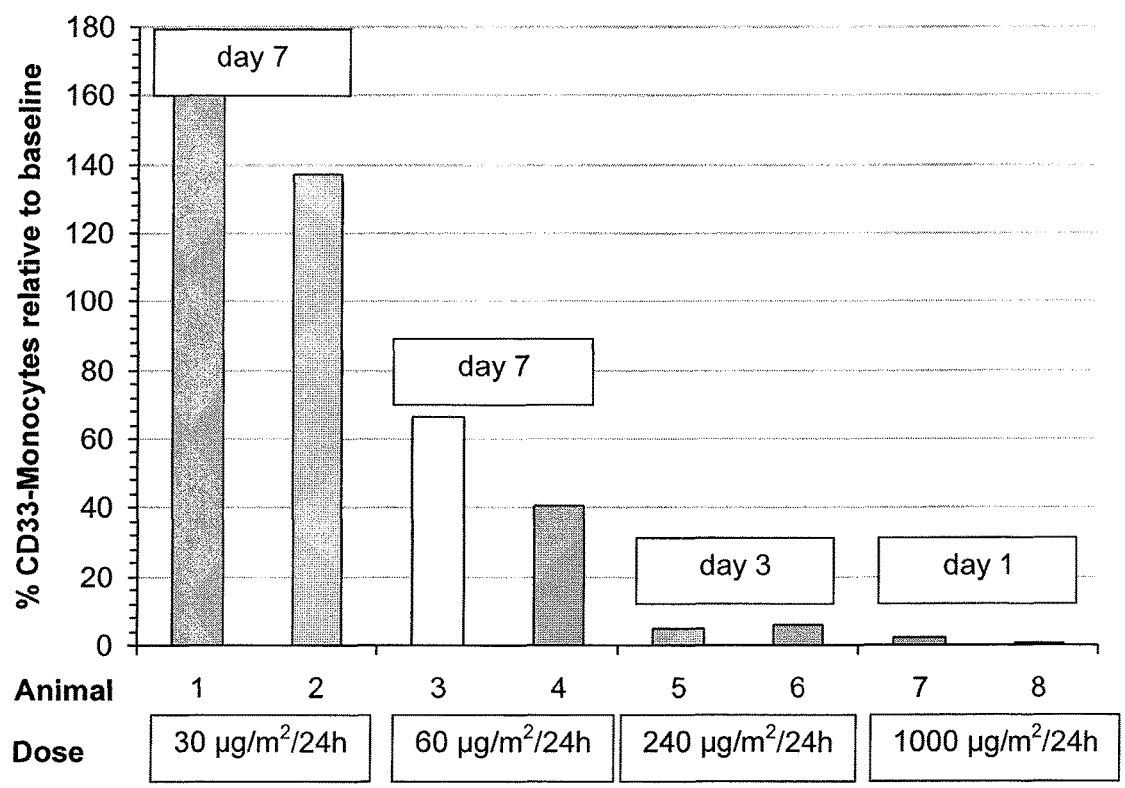
Figure 26:
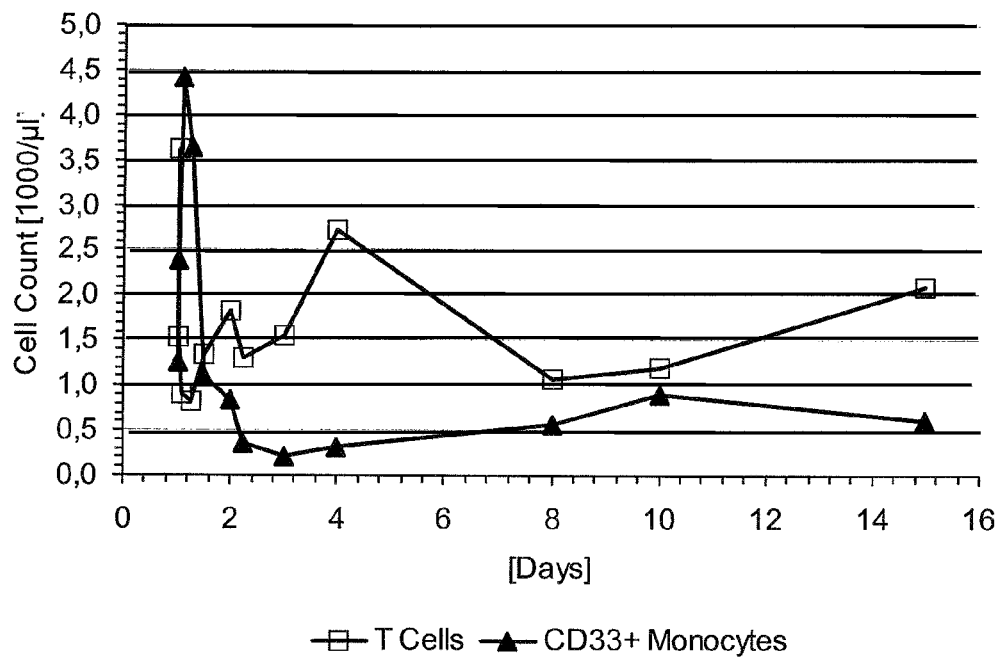
Figure 26C:
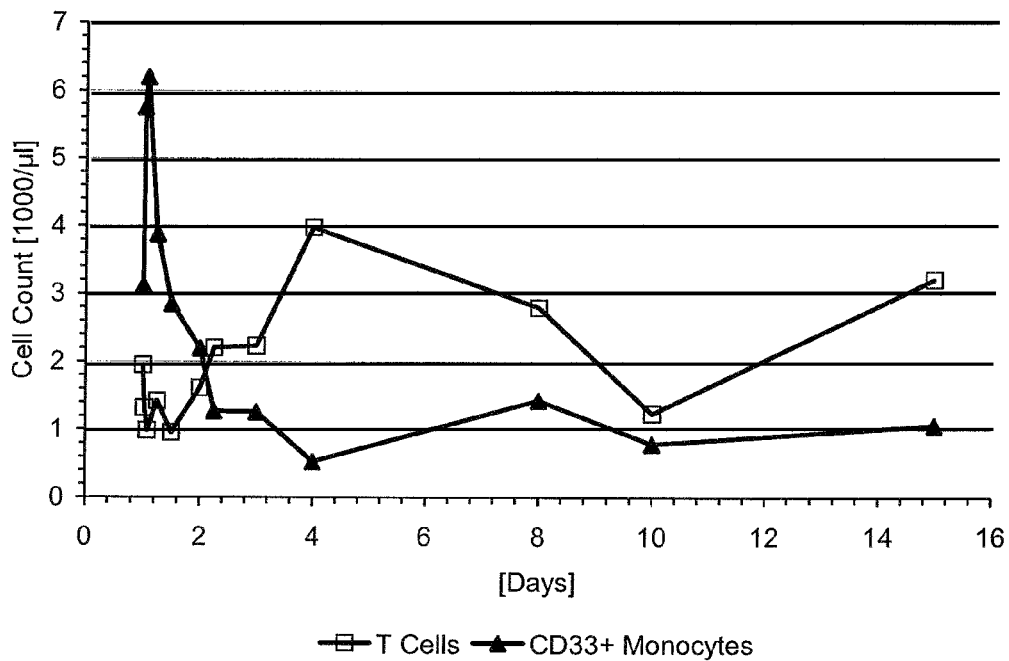

The percentage compared to baseline (i.e. 100%) of absolute circulating CD33-positive monocyte counts at the end of treatment with CD33-AF5 VH-VL×I2C VH-VL in 4 cohorts of 2 cynomolgus monkeys with inter-cohort dose escalation from 30 over 60 and 240 to 1000 μg/m²/24 h are shown in FIG. 26 A.

As shown in FIG. 26 A, continuous intravenous infusion of CD33-AF5 VH-VL×I2C VH-VL induces depletion of circulating CD33-positive monocytes in a dose-dependent manner. While there was still no detectable depletion of circulating CD33-positive monocytes at 30 μg/m²/24 h, a first trend towards a reduction of CD33-positive monocyte counts became visible at 60 μg/m²/24 h after 7 days of treatment. At 240 μg/m²/24 h circulating CD33-positive monocytes were almost completely depleted from the peripheral blood after 3 days of treatment. This was reached even faster at 1000 μg/m²/24 h, where depletion of the circulating CD33-positive monocytes from the peripheral blood was completed already after 1 day of treatment. This finding was confirmed by the results shown in FIG. 26B demonstrating depletion of circulating CD33-positive monocytes by two thirds and 50% compared to the respective baseline in two cynomolgus monkeys treated by continuous infusion with CD33-AF5 VH-VL×I2C VH-VL at 120 μg/m²/24 h for 14 days.

This outcome is a clear signal clinical efficacy of the CD3 binding molecules of the invention in general and of bispecific CD33-directed CD3 binding molecules of the invention for the treatment of CD33-positive malignomas like AML in particularly. Moreover, the T cell redistribution during the starting phase of treatment with CD33-AF5 VH-VL×I2C VH-VL in the presence of circulating target cells (i.e. CD33-positive monocytes) seems to be less pronounced than T cell redistribution during the starting phase of treatment with conventional CD19×CD3 constructs, as described in WO99/54440 in B-NHL patients with a significant number of circulating target cells (i.e. CD19-positive B cells) as shown in FIG. 22. While T cells disappear completely from the circulation upon start of CD19×CD3 infusion and do not reappear until the circulating CD19-positive target B cells are depleted from the peripheral blood (FIG. 22), initial disappearance of circulating T cells is incomplete upon infusion start with CD33-AF5 VH-VL×I2C VH-VL and T cell counts recover still during the presence of circulating CD33-positive target cells (FIG. 26 B). This confirms that CD3 binding molecules of the invention (directed against and generated against an epitope of human and non-chimpanzee primates CD3ε (epsilon) chain and being a part or fragment or the full length of the amino acid sequence as provided in SEQ ID Nos. 2, 4, 6, or 8) by recognizing a context-independent CD3 epitope show a more favorable T cell redistribution profile than conventional CD3 binding molecules recognizing a context-dependent CD3 epitope, like the binding molecules provided in WO99/54440.

Figure 27:
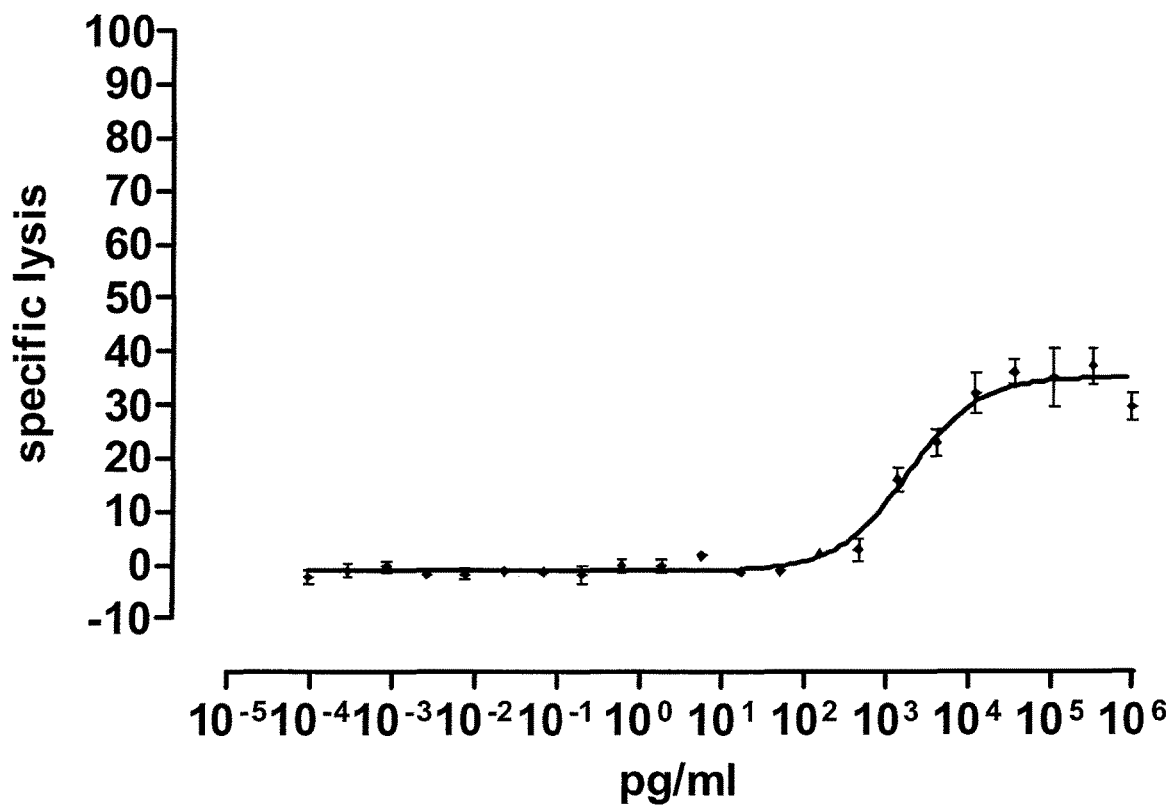
Figure 29A:
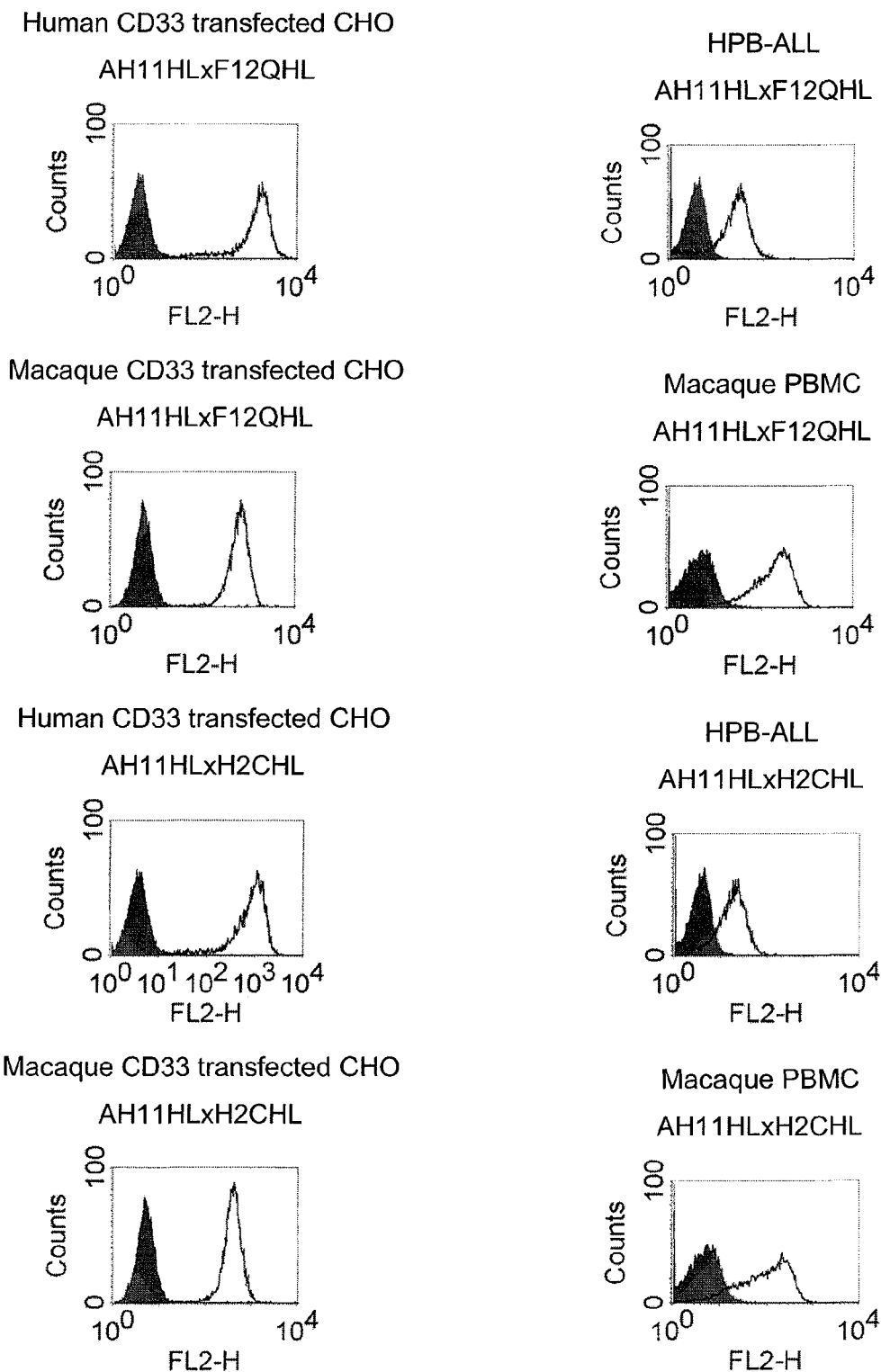
Figure 29B:
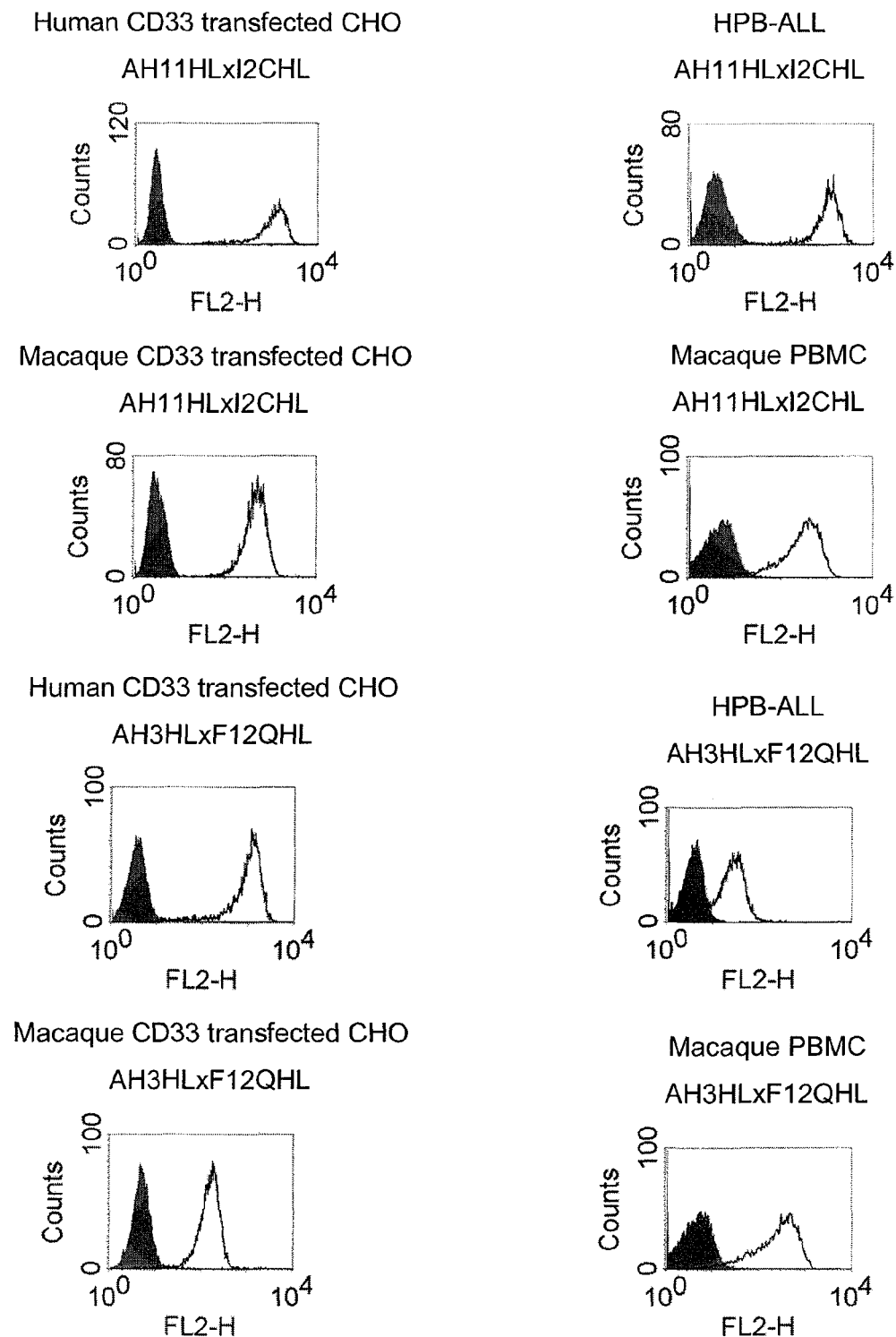
Figure 29C:
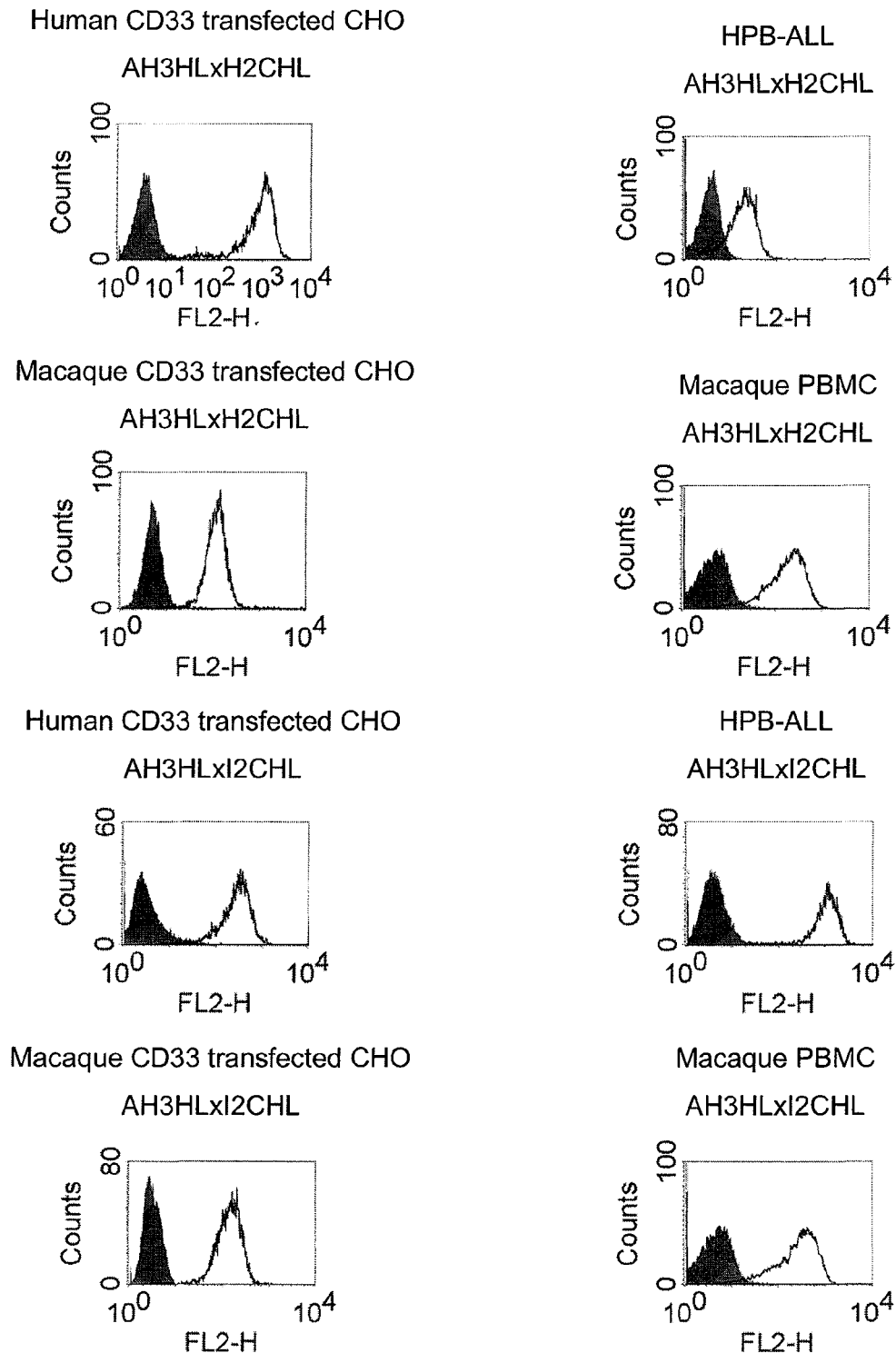
Figure 29D:
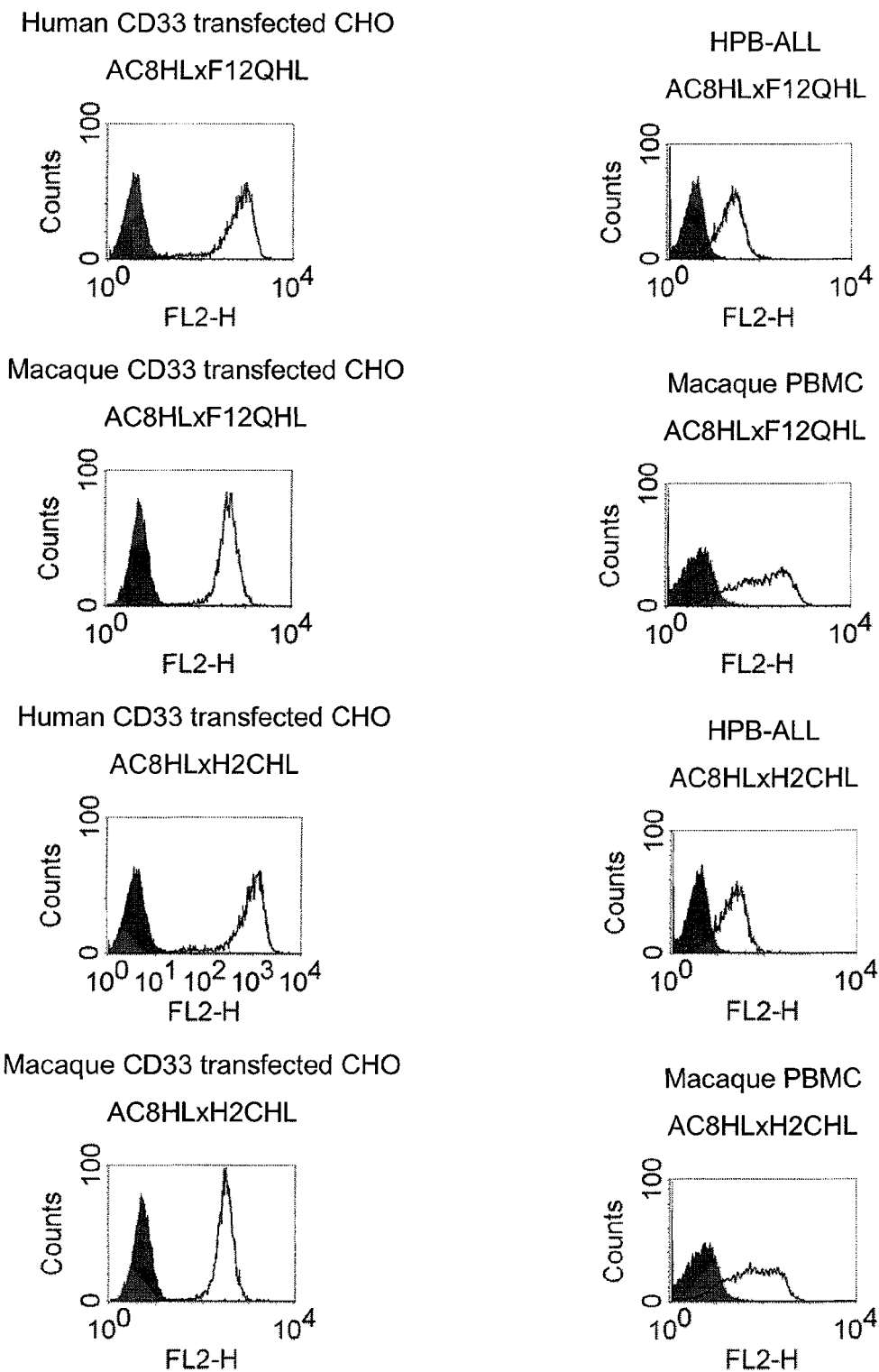
Figure 29E:
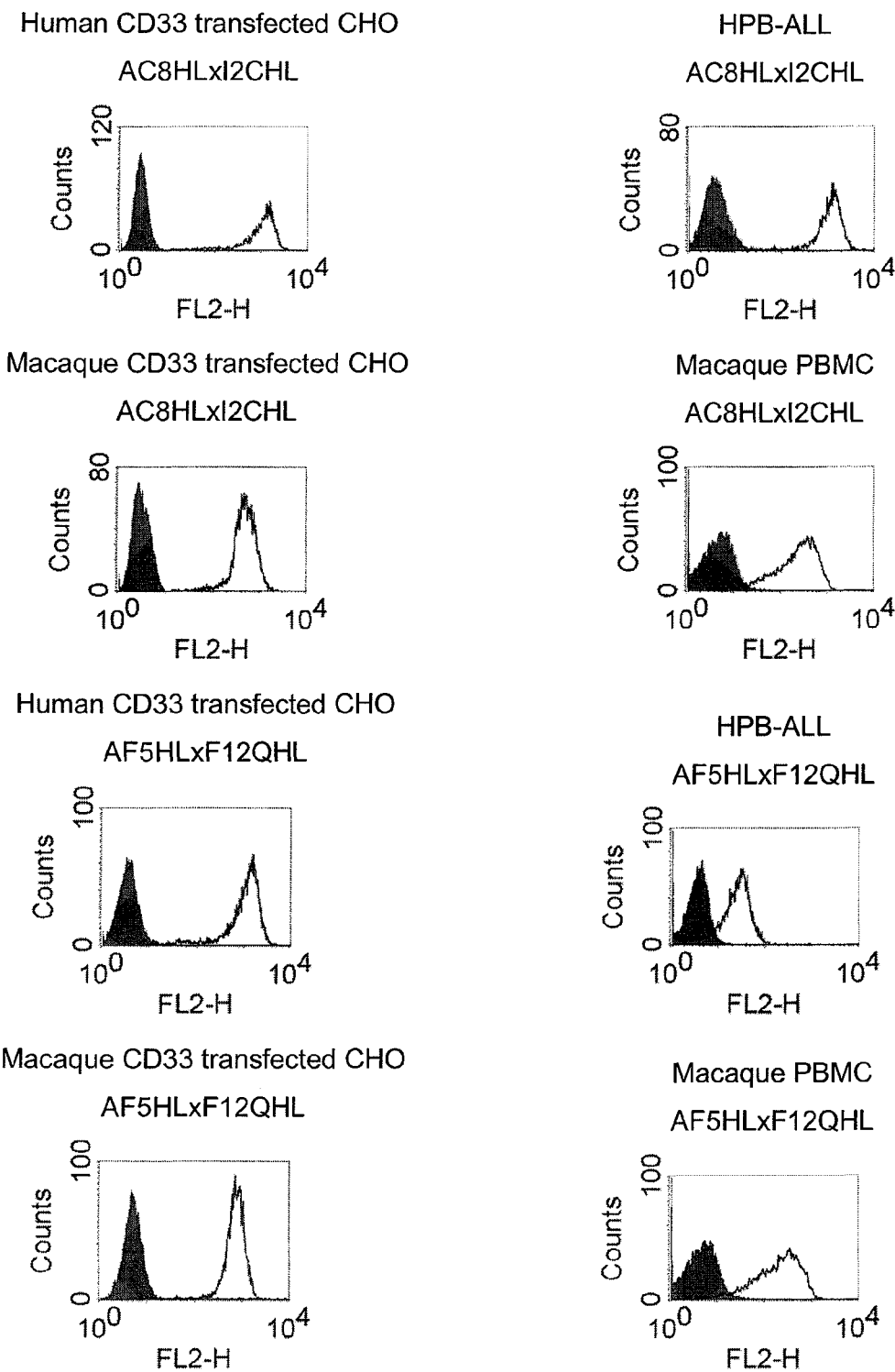
Figure 29F:
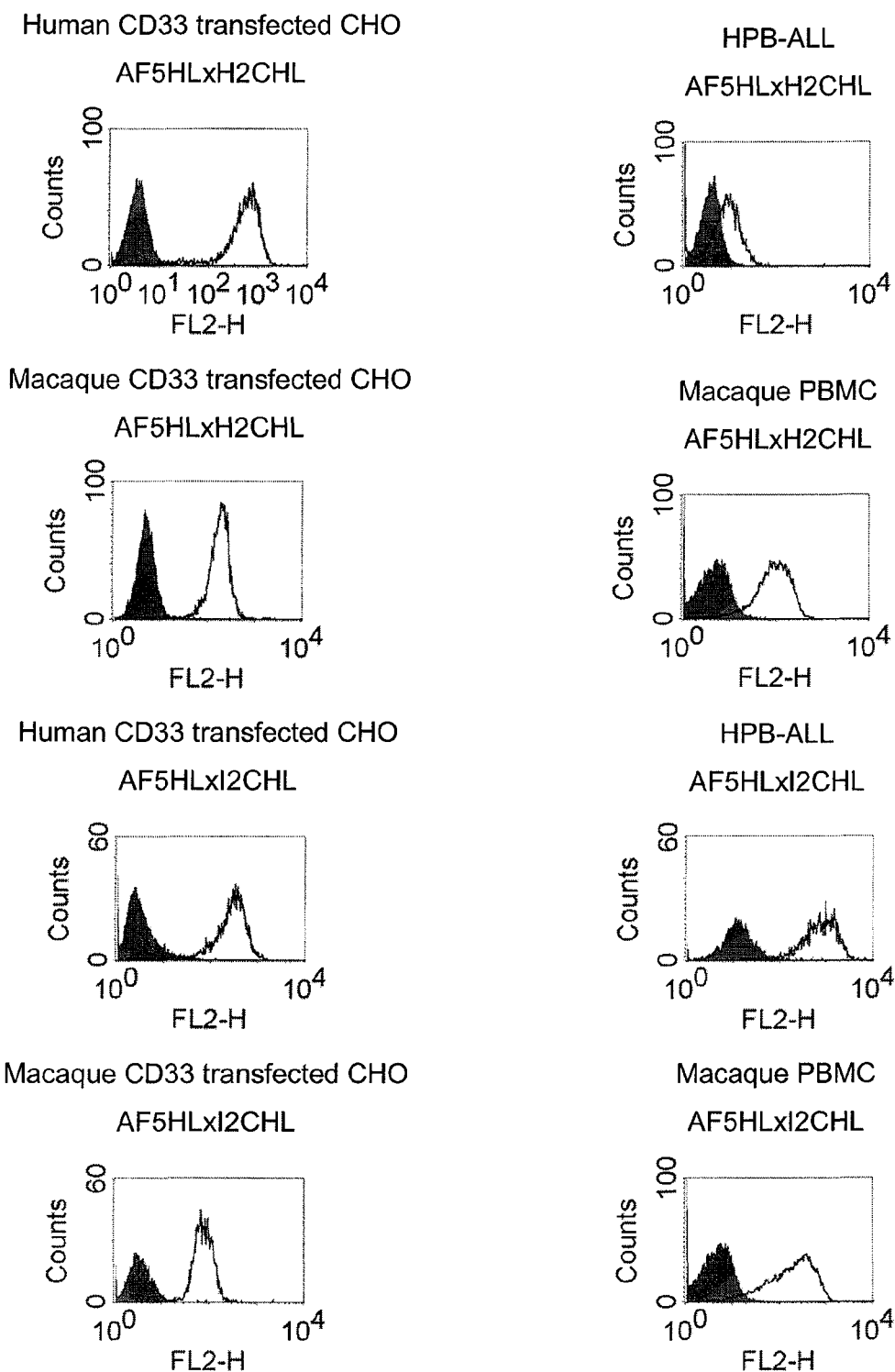
Figure 29G:
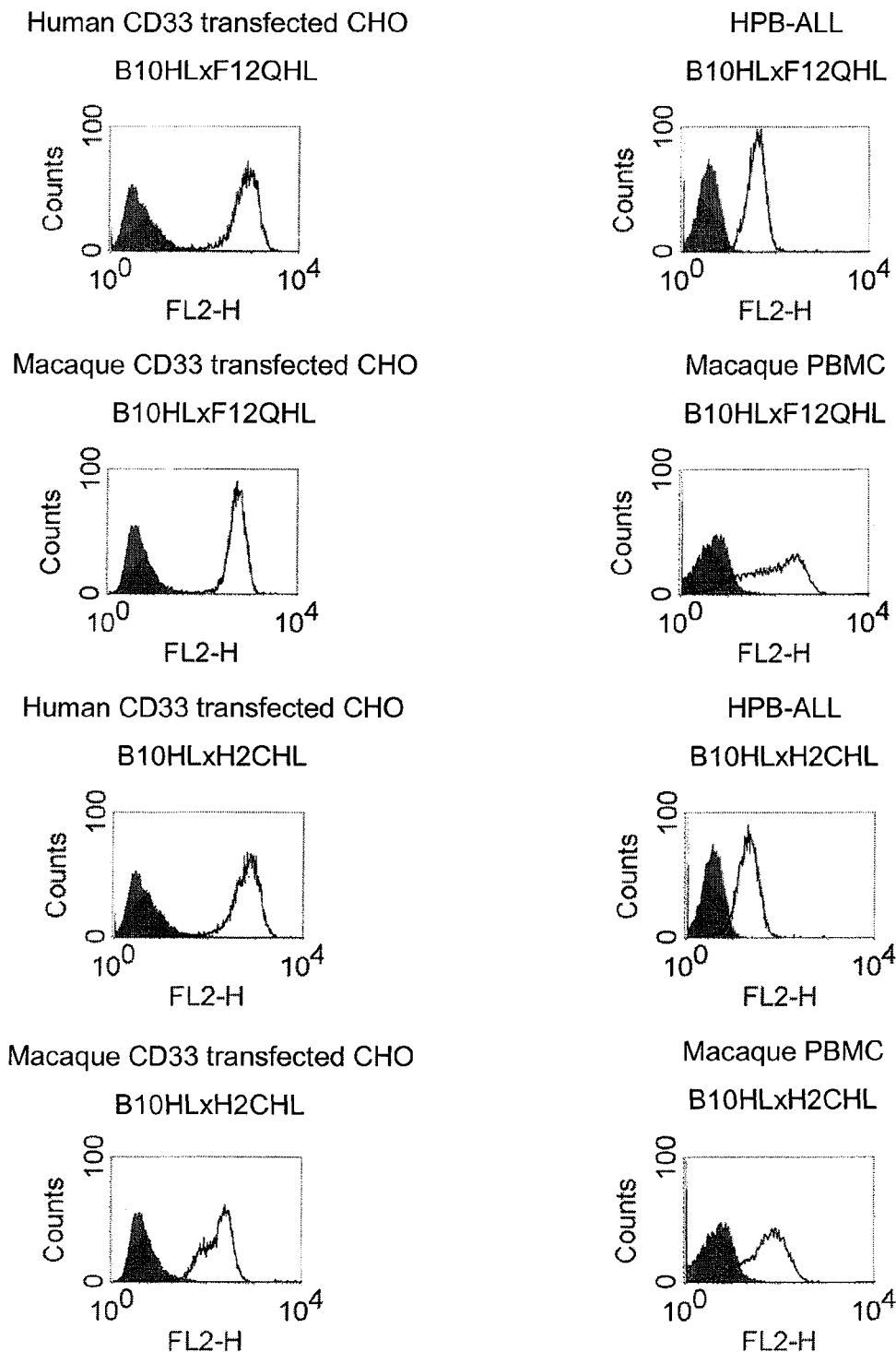
Figure 29H:
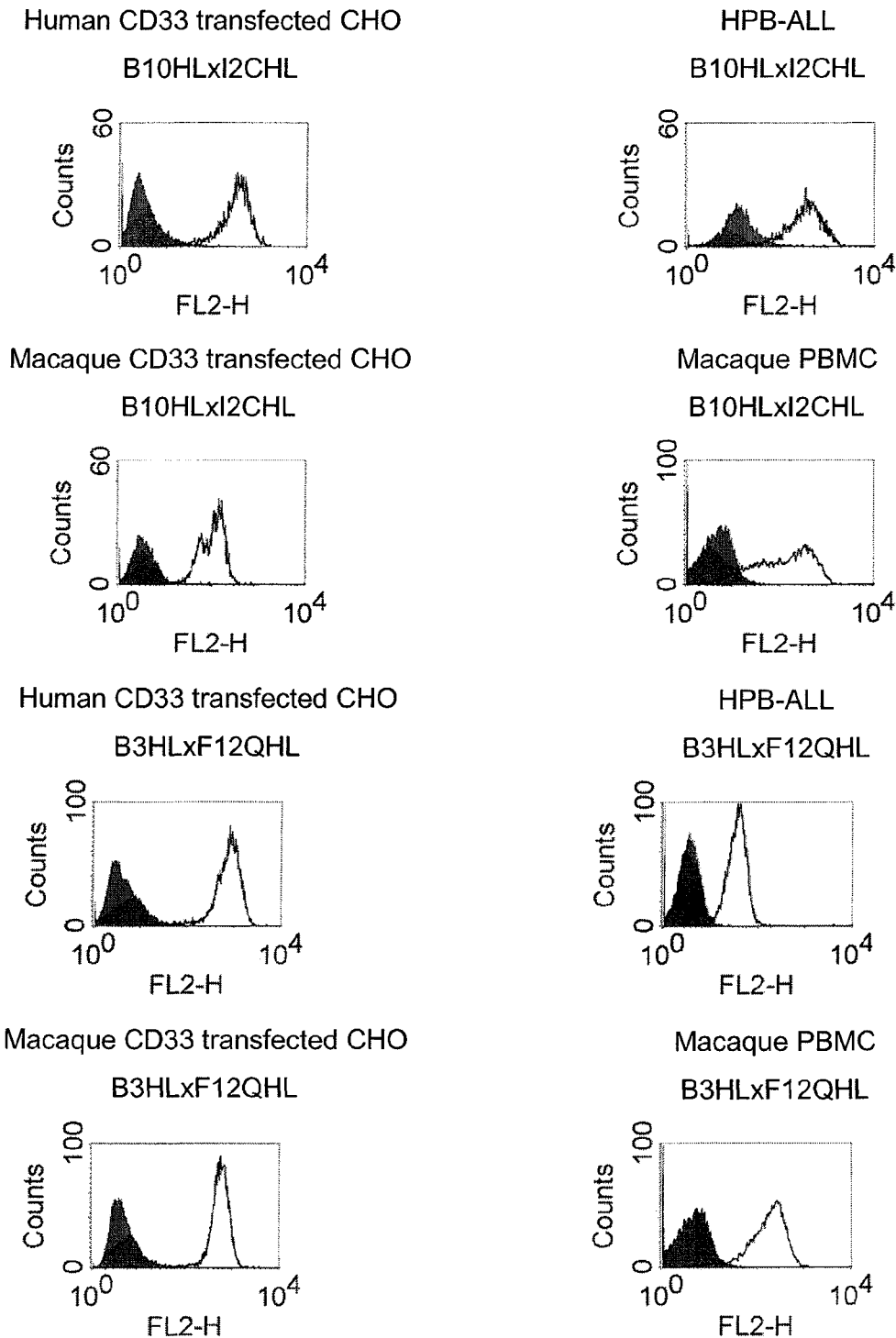
Figure 29I:
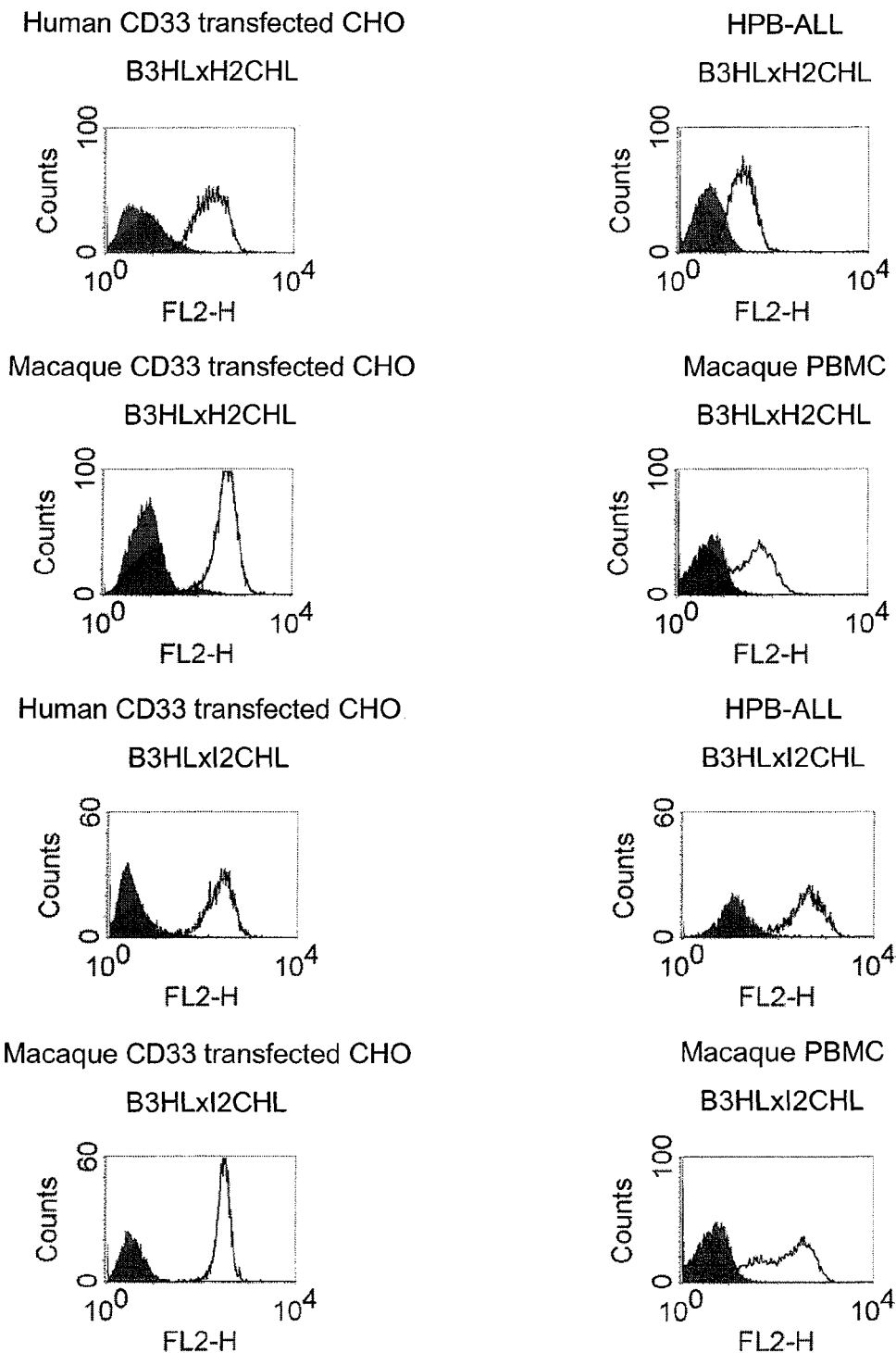
Figure 29J:
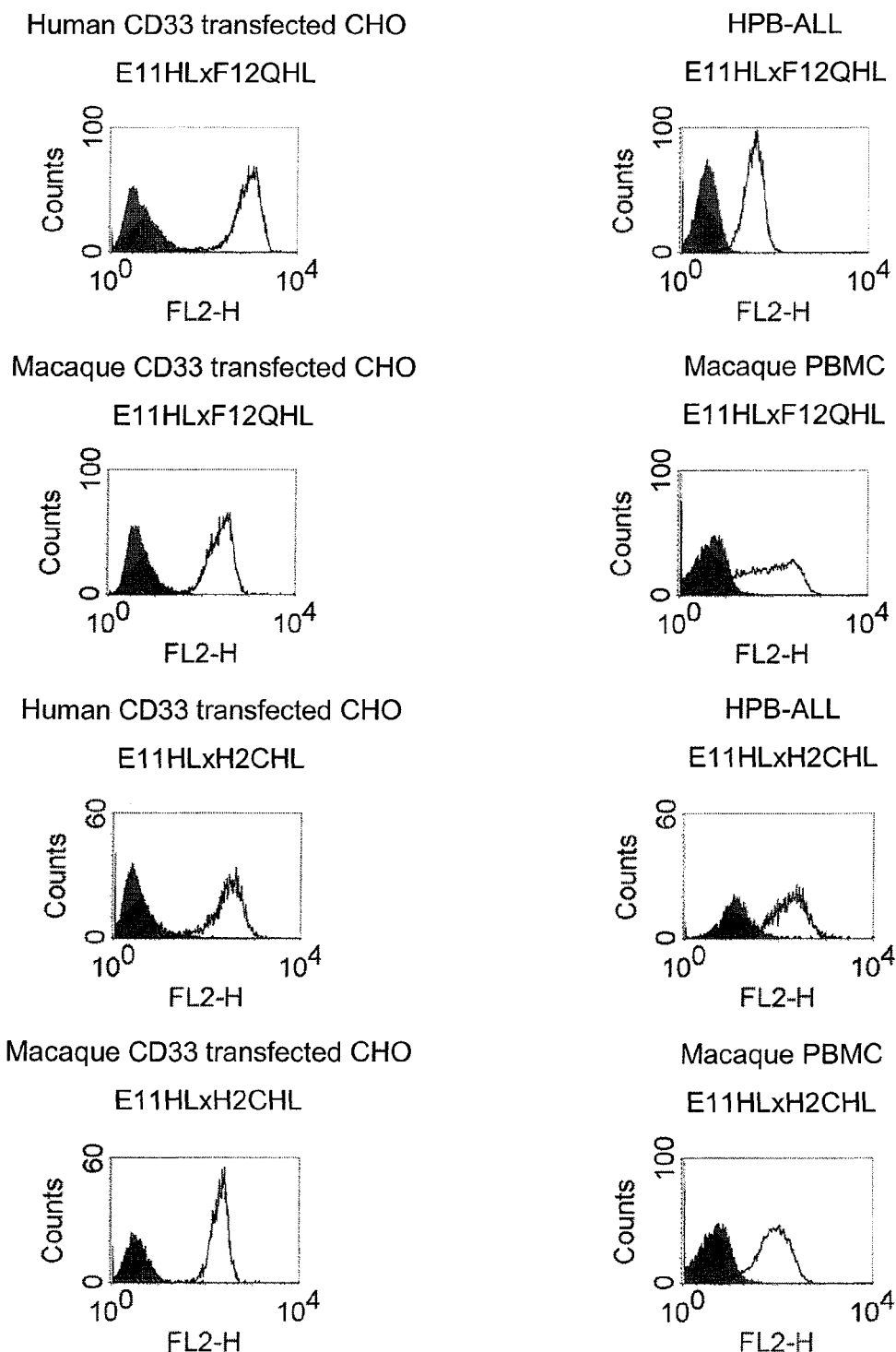
Figure 29K:
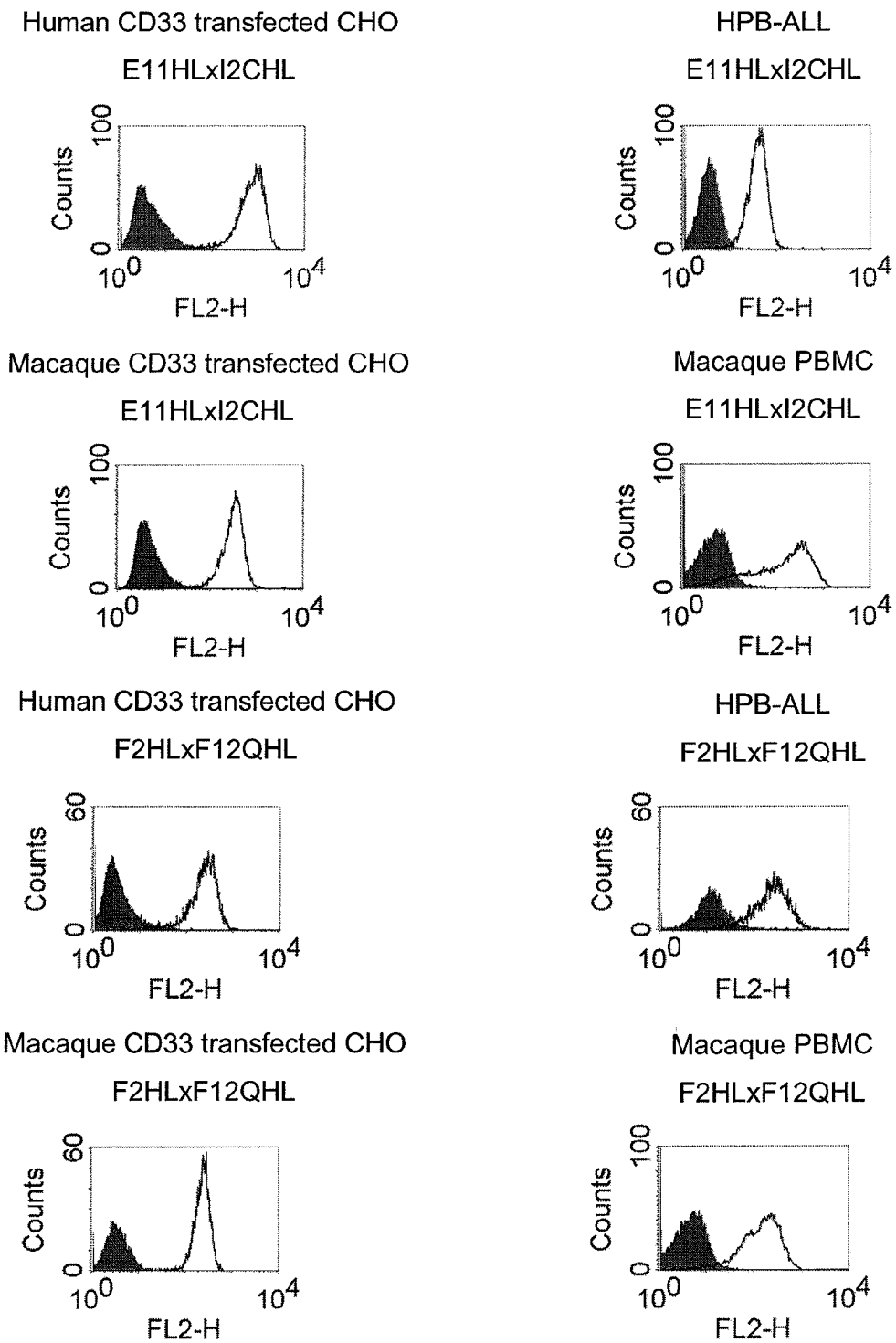
Figure 29L:
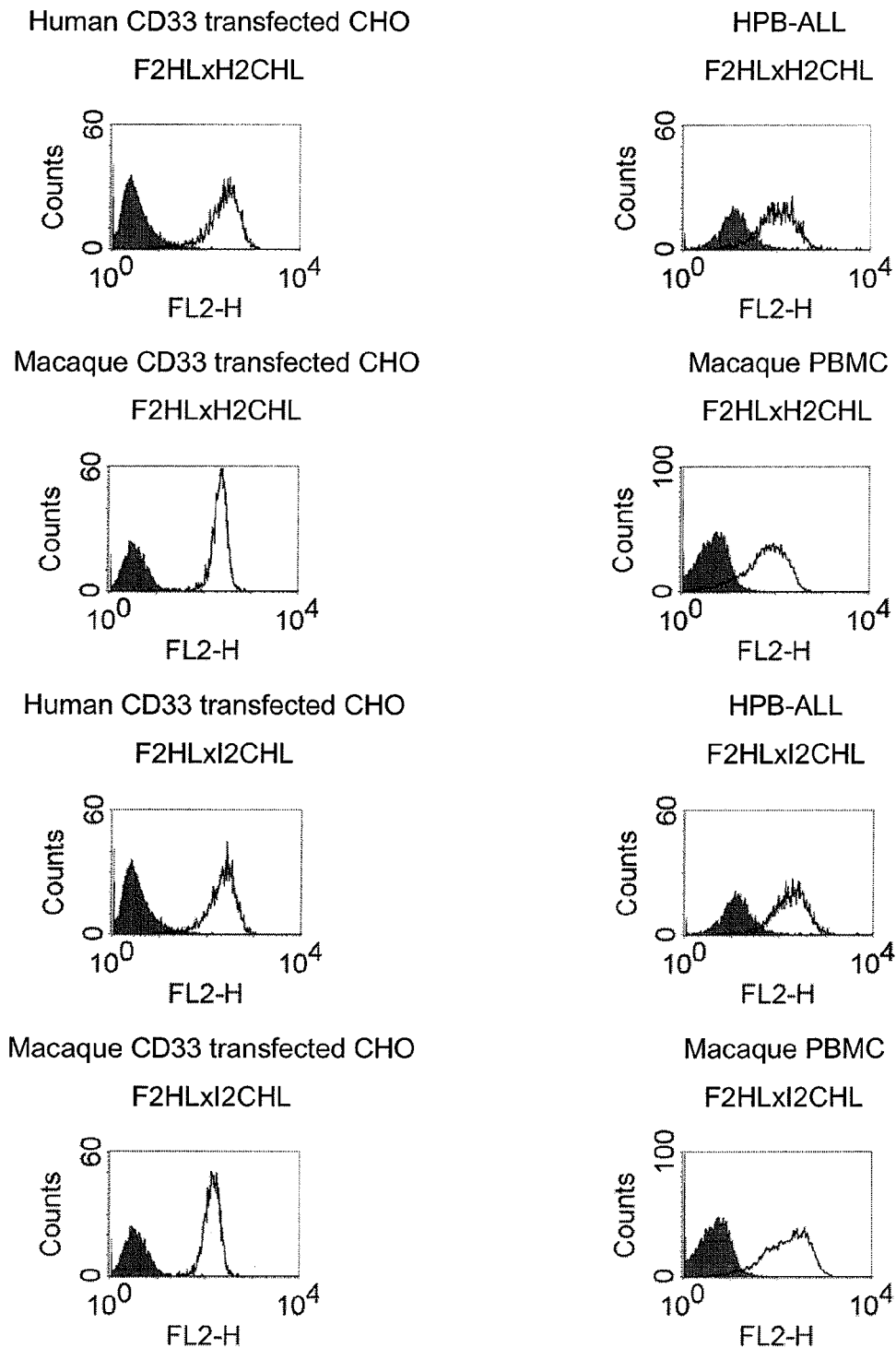

15. CD3 Binding Molecules of the Invention Directed at Essentially Context Independent CD3 Epitopes by Inducing Less Redistribution of Circulating T Cells in the Absence of Circulating Target Cells Reduce the Risk of Adverse Events Related to the Initiation of Treatment Reduced T Cell Redistribution in Cynomolgus Monkeys Following Initiation of Treatment with a Representative Cross-Species Specific CD3 Binding Molecule of the Invention MCSP-G4 VH-VL×I2C VH-VL (amino acid sequence: SEQ ID NO. 193) was produced by expression in CHO cells using the coding nucleotide sequence SEQ ID NO. 194. The coding sequences of (i) an N-terminal immunoglobulin heavy chain leader comprising a start codon embedded within a Kozak consensus sequence and (ii) a C-terminal His6-tag followed by a stop codon were both attached in frame to the nucleotide sequence SEQ ID NO. 194 prior to insertion of the resulting DNA-fragment as obtained by gene synthesis into the multiple cloning site of the expression vector pEF-DHFR (Raum et al. Cancer Immunol Immunother 50 (2001) 141-150). Stable transfection of DHFR-deficient CHO cells, selection for DHFR-positive transfectants secreting the CD3 binding molecule MCSP-G4 VH-VL×I2C VH-VL into the culture supernatant and gene amplification with methotrexat for increasing expression levels were carried out as described (Mack et al. Proc. Natl. Acad. Sci. USA 92 (1995) 7021-7025). Test material for treatment of cynomolgus monkeys was produced in a 200-liter fermenter. Protein purification from the harvest was based on IMAC affinity chromatography targeting the C-terminal His6-tag of MCSP-G4 VH-VL×I2C VH-VL followed by preparative size exclusion chromatography (SEC). The total yield of final endotoxin-free test material was 40 mg. The test material consisted of 70% monomer, 30% dimer and a small contamination of higher multimer. The potency of the test material was measured in a cytotoxicity assay as described in example 11 using CHO cells transfected with cynomolgus MCSP as target cells and the macaque T cell line 4119LnPx as source of effector cells (FIG. 27). The concentration of MCSP-G4 VH-VL×I2C VH-VL required for half-maximal target cell lysis by the effector T cells (EC50) was determined to be 1.9 ng/ml.

Young (approx. 3 years old) adult cynomolgus monkeys (*Macaca fascicularis*) were treated by continuous intravenous infusion of CD3 binding molecule MCSP-G4 VH-VL×I2C VH-VL at different flow-rates (i.e. dose levels) to study redistribution of circulating T cells following initiation of treatment in the absence of circulating target cells. Although the CD3 binding molecule MCSP-G4 VH-VL×I2C VH-VL can recognize both cynomolgus MCSP and cynomolgus CD3, there are no circulating blood cells expressing MCSP. Therefore, the only interaction possible in the circulating blood is binding of the CD3-specific arm of MCSP-G4 VH-VL×I2C VH-VL to CD3 on T cells. This situation is equivalent to the treatment with the conventional CD3 binding molecule (CD19×CD3 binding molecule specific for CD19 on B cells and CD3 on T cells) of those B-NHL patients, who have no circulating CD19-positive target B cells as described in example 13.

Continuous infusion was carried out according to the Swivel method as follows: The monkeys are catheterized via the vena *femoralis* into the vena cava caudalis using a vein catheter. The catheter is tunneled subcutaneously to the dorsal shoulder region and exteriorized at the caudal scapula. Then a tube is passed through a jacket and a protection spring. The jacket is fastened around the animal and the catheter, via the tube, is connected to an infusion pump.

Administration solution (1.25 M lysine, 0.1% TWEEN® 80, pH 7) without test material was infused continuously at 48 ml/24 h for 7 days prior to treatment start to allow acclimatization of the animals to the infusion conditions. Treatment was started by adding MCSP-G4 VH-VL×I2C VH-VL test material to the administration solution at the amount required for each individual dose level to be tested (i.e. flow rate of MCSP-G4 VH-VL×I2C VH-VL). The infusion reservoir was changed every day throughout the whole acclimatization and treatment phase. Treatment duration was 7 days.

Time courses of absolute T-cell counts in peripheral blood were determined by four color FACS analysis as follows:

Collection of Blood Samples and Routine Analysis

Blood samples (1 ml) were obtained before and 0.75, 2, 6, 12, 24, 30, 48, 72 hours after start of continuous infusion with MCSP-G4 VH-VL×I2C VH-VL as well as after 7 days of treatment using EDTA-containing Vacutainer™ tubes (Becton Dickinson) which were shipped for analysis at 4° C. In some cases slight variations of these time points occurred for operational reasons. FACS analysis of lymphocyte subpopulations was performed within 24-48 h after blood sample collection. Absolute numbers of leukocyte subpopulations in the blood samples were determined through differential blood analysis in a routine veterinary lab.

Isolation of PBMC from Blood Samples

PBMC (peripheral blood mononuclear cells) isolation was performed by an adapted Ficoll™ gradient separation protocol. Blood was transferred at room temperature into 5 ml Falcon™ tubes pre-loaded with 1 ml Biocoll™ solution (Biochrom). Centrifugation was carried out in a swing-out rotor for 15 min at 1700×g and 22° C. without deceleration. The PBMC above the Biocoll™ layer were isolated, washed once with FACS buffer (PBS/2% FBS [Foetal Bovine Serum; Biochrom]), centrifuged and resuspended in FACS buffer. Centrifugation during all wash steps was carried out in a swing-out rotor for 4 min at 800×g and 4° C. If necessary, lysis of erythrocytes was performed by incubating the isolated PBMC in 3 ml erythrocyte lysis buffer (8.29 g $NH_4Cl$, 1.00 g $KHCO_3$, 0.037 g EDTA, ad 1.0 I $H_2O_{bidest}$, pH 7.5) for 5 min at room temperature followed by a washing step with FACS buffer.

Staining of PBMC with Fluorescence-Labeled Antibodies Against Cell Surface Molecules Monoclonal antibodies reactive with cynomolgus antigens were obtained from Becton Dickinson ([1]Cat. No. 345784, [2]Cat. No. 556647, [3]Cat. No. 552851) and Beckman Coulter ([4]Cat. No. IM2470) used according to the manufacturers' recommendations. $5×10^5$-$1×10^6$ cells were stained with the following antibody combination: anti-CD14[1] (FITC)×anti-CD56[2] (PE)×anti-CD3[3] (PerCP)×anti-CD19[4] (APC). Cells were pelleted in V-shaped 96 well multititer plates (Greiner) and the supernatant was removed. Cell pellets were resuspended in a total volume of 100 μl containing the specific antibodies diluted in FACS buffer. Incubation was carried out in the dark for 30 min at 4° C. Subsequently, samples were washed twice with FACS buffer and cell pellets were resuspended in FACS buffer for flowcytometric analysis.

Flowcytometric Detection of Stained Lymphocytes by FACS

Data collection was performed with a 4 color BD FACSCalibur™ (Becton Dickinson). For each measurement $1×10^4$ cells of defined lymphocyte subpopulations were acquired. Statistical analysis was performed with the program CellQuest Pro™ (Becton Dickinson) to obtain lymphocyte subpopulation percentages and to classify cell surface molecule expression intensity. Subsequently, percentages of single lymphocyte subsets related to total lymphocytes (i.e. B plus T plus NK cells excluding myeloid cells via CD14-staining) as determined by FACS were correlated with the lymphocyte count from the differential blood analysis to calculate absolute cell numbers of T cells ($CD3^+$, $CD56^-$, $CD14^-$).

T cell redistribution during the starting phase of treatment with MCSP-G4 VH-VL×I2C VH-VL in cynomolgus monkeys at dose levels of 60, 240 and 1000 μg/m²/24 h is shown in FIG. 28. These animals showed no signs at all of any T cell redistribution during the starting phase of treatment, i.e. T cell counts rather increased than decreased upon treatment initiation. Given that T cell redistribution is consistently observed in 100% of all patients without circulating target cells, upon treatment initiation with the conventional CD3 binding molecule (e.g. CD19×CD3 construct as described in WO 99/54440) against a context dependent CD3 epitope, it was demonstrated that substantially less T cell redistribution in the absence of circulating target cells upon treatment initiation can be observed with a CD3 binding molecule of the invention directed and generated against an epitope of human an non-chimpanzee primate CD3 epsilon chain as defined by the amino acid sequence of anyone of SEQ ID NOs: 2, 4, 6, or 8 or a fragment thereof. This is in clear contrast to CD3-binding molecules directed against a context-dependent CD3 epitope, like the constructs described in WO 99/54440, The binding molecules against context-independent CD3 epitopes, as (inter alia) provided in any one of SEQ ID NOs: 2, 4, 6, or 8 (or fragments of these sequences) provide for this substantially less (detrimental and non-desired) T cell redistribution. Because T cell redistribution during the starting phase of treatment with CD3 binding molecules is a major risk factor for CNS adverse events, the CD3 binding molecules provided herein and capable of recognizing a context independent CD3 epitope have a substantial advantage over the CD3 binding molecules known in the art and directed against context-dependent CD3 epitopes. Indeed none of the cynomolgus monkeys treated with MCSP-G4 VH-VL×I2C VH-VL showed any signs of CNS symptoms.

The context-independence of the CD3 epitope is provided in this invention and corresponds to the first 27 N-terminal amino acids of CD3 epsilon) or fragments of this 27 amino acid stretch. This context-independent epitope is taken out of its native environment within the CD3 complex and fused to heterologous amino acid sequences without loss of its structural integrity. Anti-CD3 binding molecules as provided herein and generated (and directed) against a context-independent CD3 epitope provide for a surprising clinical improvement with regard to T cell redistribution and, thus, a more favorable safety profile. Without being bound by theory, since their CD3 epitope is context-independent, forming an autonomous selfsufficient subdomain without much influence on the rest of the CD3 complex, the CD3 binding molecules provided herein induce less allosteric changes in CD3 conformation than the conventional CD3 binding molecules (like molecules provided in WO 99/54440), which recognize context-dependent CD3 epitopes like molecules provided in WO 99/54440. As a consequence (again without being bound by theory), the induction of intracellular NcK2 recruitment by the CD3 binding molecules provided herein is also reduced resulting in less isoform switch of T cell integrins and less adhesion of T cells to endothelial cells. It is preferred that preparations of CD3 binding molecules of the invention (directed against and generated against a context-independent epitope as defined herein) essentially consists of monomeric molecules. These monomeric molecules are even more efficient (than dimeric or multimeric molecules) in avoiding T cell redistribution and thus the risk of CNS adverse events during the starting phase of treatment.

16. Generation and Characterization of CD33 and CD3 Cross-Species Specific Bispecific Single Chain Molecules 16.1. Generation of CHO Cells Expressing Human CD33

The coding sequence of human CD33 as published in GenBank® (Accession number NM_001772) was obtained by gene synthesis according to standard protocols. The gene synthesis fragment was designed as to contain first a Kozak site for eukaryotic expression of the construct, followed by a 19 amino acid immunoglobulin leader peptide, followed in frame by the coding sequence of the mature human CD33 protein, followed in frame by the coding sequence of serine glycine dipeptide, a histidine$_6$-tag and a stop codon (the cDNA and amino acid sequence of the construct is listed under SEQ ID Nos 305 and 306). The gene synthesis fragment was also designed as to introduce restriction sites at the beginning and at the end of the fragment. The introduced restriction sites, EcoRI at the 5' end and SalI at the 3' end, were utilised in the following cloning procedures. The gene synthesis fragment was cloned via EcoRI and SalI into a plasmid designated pEF-DHFR (pEF-DHFR is described in Raum et al. Cancer Immunol Immunother 50 (2001) 141-150) following standard protocols. The aforementioned procedures were carried out according to standard protocols (Sambrook, Molecular Cloning; A Laboratory Manual, 3rd edition, Cold Spring Harbour Laboratory Press, Cold Spring Harbour, New York (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methothrexate (MTX) to a final concentration of up to 20 nM MTX.

16.2. Generation of CHO Cells Expressing the Extracellular Domain of Macaque CD33

The cDNA sequence of macaque CD33 was obtained by a set of 3 PCRs on cDNA from macaque monkey bone marrow prepared according to standard protocols. The following reaction conditions: 1 cycle at 94° C. for 3 minutes followed by 35 cycles with 94° C. for 1 minute, 53° C. for 1 minute and 72° C. for 2 minutes followed by a terminal cycle of 72° C. for 3 minutes and the following primers were used:

1. forward primer:
(SEQ ID No. 369)
5'-gaggaattcaccatgccgctgctgctactgctgcccctgctgtggg cagggccctggctatgg-3' reverse primer:
(SEQ ID No. 370)
5'-gatttgtaactgtatttggtacttcc-3'

2. forward primer:
(SEQ ID No. 371)
5'-attccgcctccttggggatcc-3' reverse primer:
(SEQ ID No. 372)
5'-gcataggagacattgagctggatgg-3'

3. forward primer:
(SEQ ID No. 373)
5'-gcaccaacctgacctgtcagg-3' reverse primer:
(SEQ ID No. 374)
5'-agtgggtcgactcactgggtcctgacctctgagtattcg-3'

Those PCRs generate three overlapping fragments, which were isolated and sequenced according to standard protocols using the PCR primers, and thereby provided a portion of the cDNA sequence of macaque CD33 from the second nucleotide of codon +2 to the third nucleotide of codon +340 of the mature protein. To generate a construct for expression of macaque CD33 a cDNA fragment was obtained by gene synthesis according to standard protocols (the cDNA and amino acid sequence of the construct is listed under SEQ ID Nos 307 and 308). In this construct the coding sequence of macaque CD33 from amino acid +3 to +340 of the mature CD33 protein was fused into the coding sequence of human CD33 replacing the human coding sequence of the amino acids +3 to +340. The gene synthesis fragment was also designed as to contain a Kozak site for eukaryotic expression of the construct and restriction sites at the beginning and the end of the fragment containing the cDNA coding for essentially the whole extracellular domain of macaque CD33, the macaque CD33 transmembrane domain and a macaque-human chimeric intracellular CD33 domain. The introduced restriction sites XbaI at the 5' end and SalI at the 3' end, were utilised in the following cloning procedures. The gene synthesis fragment was then cloned via XbaI and SalI into a plasmid designated pEF-DHFR (pEF-DHFR is described in Raum et al. Cancer Immunol Immunother 50 (2001) 141-150). A sequence verified clone of this plasmid was used to transfect CHO/dhfr-cells as described above.

16.3. Generation of CD33 and CD3 Cross-Species Specific Bispecific Antibody Molecules Cloning of Cross-Species Specific Binding Molecules Generally, bispecific antibody molecules, each comprising a domain with a binding specificity cross-species specific for human and non-chimpanzee primate CD3 epsilon as well as a domain with a binding specificity cross-species specific for human and non-chimpanzee primate CD33, were designed as set out in the following Table 5:

TABLE 5

Formats of anti-CD3 and anti-CD33 cross-species specific bispecific molecules

| SEQ ID (nucl/prot) | Formats of protein constructs (N → C) |
|---|---|
| 276/275 | AH11HLxH2CHL |
| 258/257 | AH3HLxH2CHL |
| 270/269 | AC8HLxH2CHL |
| 264/263 | AF5HLxH2CHL |
| 288/287 | F2HLxH2CHL |
| 300/299 | E11HLxH2CHL |
| 282/281 | B3HLxH2CHL |
| 294/293 | B10HLxH2CHL |
| 278/277 | AH11HLxF12QHL |
| 260/259 | AH3HLxF12QHL |
| 272/271 | AC8HLxF12QHL |
| 266/265 | AF5HLxF12QHL |
| 290/289 | F2HLxF12QHL |
| 302/301 | E11HLxF12QHL |
| 284/283 | B3HLxF12QHL |
| 296/295 | B10HLxF12QHL |
| 280/279 | AH11HLxI2CHL |
| 262/261 | AH3HLxI2CHL |
| 274/273 | AC8HLxI2CHL |
| 268/267 | AF5HLxI2CHL |
| 292/291 | F2HLxI2CHL |
| 304/303 | E11HLxI2CHL |
| 286/285 | B3HLxI2CHL |
| 298/297 | B10HLxI2CHL |

The aforementioned constructs containing the variable light-chain (L) and variable heavy-chain (H) domains cross-species specific for human and macaque CD33 and the CD3 specific VH and VL combinations cross-species specific for human and macaque CD3 were obtained by gene synthesis. The gene synthesis fragments were designed as to contain first a Kozak site for eukaryotic expression of the construct, followed by a 19 amino acid immunoglobulin leader peptide, followed in frame by the coding sequence of the respective bispecific antibody molecule, followed in frame by the coding sequence of a histidine$_6$-tag and a stop codon. The gene synthesis fragment was also designed as to introduce suitable restriction sites at the beginning and at the end of the fragment. The introduced restriction sites were utilized in the following cloning procedures. The gene synthesis fragment was cloned via these restriction sites into a plasmid designated pEF-DHFR (pEF-DHFR is described in Raum et al. Cancer Immunol Immunother 50 (2001) 141-150) following standard protocols. The aforementioned procedures were carried out according to standard protocols (Sambrook, Molecular Cloning; A Laboratory Manual, 3rd edition, Cold Spring Harbour Laboratory Press, Cold Spring Harbour, New York (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methothrexate (MTX) to a final concentration of up to 20 nM MTX.

Expression and Purification of the Bispecific Antibody Molecules

The bispecific antibody molecules are expressed in Chinese hamster ovary cells (CHO). Eukaryotic protein expression in DHFR deficient CHO cells was performed as described by Kaufmann R. J. (1990) Methods Enzymol. 185, 537-566. Gene amplification of the constructs was induced by addition of increasing concentrations of MTX up to final concentrations of 20 nM MTX. After two passages of stationary culture the cells were grown in roller bottles with nucleoside-free HyQ PF CHO™ liquid soy medium (with 4.0 mM L-Glutamine with 0.1% Pluronic F—68; HyClone) for 7 days before harvest. The cells were removed by centrifugation and the supernatant containing the expressed protein was stored at −20° C. Alternatively, constructs were transiently expressed in HEK 293 cells. Transfection was performed with 293Fectin™ reagent (Invitrogen, #12347-019) according to the manufacturer's protocol.

Äkta® Explorer System (GE Health Systems) and Unicorn® Software were used for chromatography. Immobilized metal affinity chromatography ("IMAC") was performed using a Fractogel EMD Chelate® (Merck) which was loaded with ZnCl$_2$ according to the protocol provided by the manufacturer. The column was equilibrated with buffer A (20 mM sodium phosphate buffer pH 7.2, 0.1 M NaCl) and the cell culture supernatant (500 ml) was applied to the column (10 ml) at a flow rate of 3 ml/min. The column was washed with buffer A to remove unbound sample. Bound protein was eluted using a two step gradient of buffer B (20 mM sodium phosphate buffer pH 7.2, 0.1 M NaCl, 0.5 M Imidazole) according to the following:

Step 1: 20% buffer B in 6 column volumes

Step 2: 100% buffer B in 6 column volumes

Eluted protein fractions from step 2 were pooled for further purification. All chemicals were of research grade and purchased from Sigma (Deisenhofen) or Merck (Darmstadt).

Gel filtration chromatography was performed on a HiLoad 16/60 Superdex® 200 prep grade column (GE/Amersham) equilibrated with Equi-buffer (25 mM Citrate, 200 mM Lysine, 5% Glycerol, pH 7.2). Eluted protein samples (flow rate 1 ml/min) were subjected to standard SDS-PAGE and Western Blot for detection. Prior to purification, the column was calibrated for molecular weight determination (molecular weight marker kit, Sigma MW GF-200). Protein concentrations were determined using OD280 nm.

Purified bispecific antibody protein was analyzed in SDS PAGE under reducing conditions performed with pre-cast 4-12% Bis Tris gels (Invitrogen). Sample preparation and application were performed according to the protocol provided by the manufacturer. The molecular weight was determined with MultiMark® protein standard (Invitrogen). The gel was stained with colloidal Coomassie (Invitrogen protocol). The purity of the isolated protein is >95% as determined by SDS-PAGE.

The bispecific antibody has a molecular weight of about 52 kDa under native conditions as determined by gel filtration in PBS. All constructs were purified according to this method.

Western Blot was performed using an Optitran® BA-S83 membrane and the Invitrogen Blot Module according to the protocol provided by the manufacturer. For detection of the bispecific antibody protein antibodies an anti-His Tag antibody was used (Penta His, Qiagen). A Goat-anti-mouse Ig antibody labeled with alkaline phosphatase (AP) (Sigma) was used as secondary antibody and BCIP/NBT (Sigma) as substrate. A single band was detected at 52 kD corresponding to the purified bispecific antibody.

16.4. Flow Cytometric Binding Analysis of the CD33 and CD3 Cross-Species Specific Bispecific Antibodies In order to test the functionality of the cross-species specific bispecific antibody constructs regarding the capability to bind to human and macaque CD33 and CD3, respectively, a FACS analysis was performed. For this purpose CHO cells transfected with human CD33 as described in Example 16.1 and the human CD3 positive T cell leukemia cell line HPB-ALL (DSMZ, Braunschweig, ACC483) were used to test the binding to human antigens. The binding reactivity to macaque antigens was tested by using the generated macaque CD33 transfectant described in Example 16.2 and macaque PBMC (preparation of macaque PBMC was performed by Ficoll gradient centrifugation of peripheral blood from macaque monkeys according to standard protocolls). 200.000 cells of the respective cell lines of PBMC were incubated for 30 min. on ice with 50 µl of the purified protein of the cross-species specific bispecific antibody constructs (5 µg/ml) or cell culture supernatant of transfected cells expressing the cross-species specific bispecific antibody constructs. The cells were washed twice in PBS with 2% FCS and binding of the construct was detected with a murine anti-His antibody (Penta His antibody; Qiagen; diluted 1:20 in 50 µl PBS with 2% FCS). After washing, bound anti-His antibodies were detected with an Fc gamma-specific antibody (Dianova) conjugated to phycoerythrin, diluted 1:100 in PBS with 2% FCS. Supernatant of untransfected CHO cells was used as negative control.

Flow cytometry was performed on a FACSCalibur™ apparatus; the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

The specific binding of human and non-chimpanzee primate CD3 of the CD3 binding molecules of the invention was clearly detectable as shown in FIGS. 29A-L. In the FACS analysis all constructs show binding to CD3 and CD33 as compared to the respective negative controls. Cross-species specificity of the bispecific antibodies to human and macaque CD3 and CD33 antigens is demonstrated.

16.5. Bioactivity of CD33 and CD3 Cross-Species Specific Bispecific Antibodies

Bioactivity of the generated bispecific antibodies was analyzed by chromium 51 ($^{51}$Cr) release in vitro cytotoxicity assays using the CD33 positive cell lines described in Examples 16.1 and 16.2. As effector cells stimulated human CD4/CD56 depleted PBMC or the macaque T cell line 4119LnPx were used as specified in the respective figures.

Generation of stimulated human PBMC was performed as follows:

A Petri dish (85 mm diameter, Nunc) was coated with a commercially available anti-CD3 specific antibody (e.g. OKT3, Othoclone) in a final concentration of 1 µg/ml for 1 hour at 37° C. Unbound protein was removed by one washing step with PBS. The fresh PBMC were isolated from peripheral blood (30-50 ml human blood) by Ficoll gradient centrifugation according to standard protocols. 3-5×10$^7$ PBMC were added to the precoated petri dish in 50 ml of RPMI 1640 with stabilized glutamine/10% FCS/IL-2 20 U/ml (Proleukin®, Chiron) and stimulated for 2 days. On the third day the cells were collected and washed once with RPMI 1640. IL-2 was added to a final concentration of 20 U/ml and the cells were cultivated again for one day in the same cell culture medium as above.

Target cells were washed twice with PBS and labeled with 11.1 MBq $^{51}$Cr in a final volume of 100 µl RPMI with 50% FCS for 45 minutes at 37° C. Subsequently the labeled target cells were washed 3 times with 5 ml RPMI and then used in the cytotoxicity assay. The assay was performed in a 96 well plate in a total volume of 250 µl supplemented RPMI (as above) with an E:T ratio of 10:1. 1 µg/ml of the cross-species specific bispecific antibody molecules and 20 threefold dilutions thereof were applied. The assay time was 18 hours and cytotoxicity was measured as relative values of released chromium in the supernatant related to the difference of maximum lysis (addition of Triton©-X) and spontaneous lysis (without effector cells). All measurements were done in quadruplicates. Measurement of chromium activity in the supernatants was performed with a Wizard 3" (Wizard$^{31}$) gamma counter (Perkin Elmer Life Sciences GmbH, Köln, Germany). Analysis of the experimental data was performed with Prism 4 for Windows (version 4.02, GraphPad Software Inc., San Diego, California, USA). Sigmoidal dose response curves typically have $R^2$ values >0.90 as determined by the software. EC50 values calculated by the analysis program were used for comparison of bioactivity.

As shown in FIGS. 30A-30H, all of the generated cross-species specific bispecific constructs demonstrate cytotoxic activity against human CD33 positive target cells elicited by stimulated human CD4/CD56 depleted PBMC and against macaque CD33 positive target cells elicited by the macaque T cell line 4119LnPx.

17. Purification of Cross-Species Specific Bispecific Single Chain Molecules by an Affinity Procedure Based on the Context Independent CD3 Epsilon Epitope Corresponding to the N-Terminal Amino Acids 1-27

17.1 Generation of an Affinity Column Displaying the Isolated Context Independent Human CD3 Epsilon Epitope Corresponding to the N-Terminal Amino Acids 1-27

The plasmid for expression of the construct 1-27 CD3-Fc consisting of the 1-27 N-terminal amino acids of the human CD3 epsilon chain fused to the hinge and Fc gamma region of human immunoglobulin IgG1 described above (Example 3; cDNA sequence and amino acid sequence of the recombinant fusion protein are listed under SEQ ID NOs 230 and 229) was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX. After two passages of stationary culture the cells were grown in roller bottles with nucleoside-free HyQ PF CHO™ liquid soy medium (with 4.0 mM L-Glutamine with 0.1% Pluronic F—68; HyClone) for 7 days before harvest. The cells were removed by centrifugation and the supernatant containing the expressed protein was stored at −20° C. For the isolation of the fusion protein a goat anti-human fc affinity column was prepared according to standard protocols using a commercially available affinity purified goat anti-human IgG fc fragment specific antibody with minimal cross-reaction to bovine, horse, and mouse serum proteins (Jackson ImmunoResearch Europe Ltd.). Using this affinity column the fusion protein was isolated out of cell culture supernatant on an Äkta® Explorer System (GE Amersham) and eluted by citric acid. The eluate was neutralized and concentrated. After dialysis against amine free coupling buffer the purified fusion protein was coupled to an N-Hydroxy-Succinimide NHS activated 1 ml HiTrap® column (GE Amersham).

After coupling remaining NHS groups were blocked and the column was washed and stored at 5° C. in storage buffer containing 0.1% sodium azide.

17.2 Purification of Cross-Species Specific Bispecific Single Chain Molecules Using a Human CD3 Peptide Affinity Column 200 ml cell culture supernatant of cells expressing cross-species specific bispecific single chain molecules were 0.2 µm sterile filtered and applied to the CD3 peptide affinity column using an Äkta® Explorer system (GE Amersham).

The column was then washed with phosphate buffered saline PBS pH 7.4 to wash out unbound sample. Elution was done with an acidic buffer pH 3.0 containing 20 mM Citric acid and 1 M sodium chloride. Eluted protein was neutralized immediately by 1 M Trishydroxymethylamine TRIS pH 8.3 contained in the collection tubes of the fraction collector.

Protein analysis was done by SDS PAGE and Western Blot.

For SDS PAGE BisTris Gels 4-12% are used (Invitrogen). The running buffer was 1×MES-SDS-Puffer (Invitrogen). As protein standard 15 µl prestained Sharp Protein Standard (Invitrogen) was applied. Electrophoresis was performed for 60 minutes at 200 volts 120 mA max. Gels were washed in demineralised water and stained with Coomassie for one hour. Gels are destained in demineralised water for 3 hours. Pictures are taken with a Syngene Gel documentation system.

For Western Blot a double of the SDS PAGE gel was generated and proteins were electroblotted onto a nitrocellulose membrane. The membrane was blocked with 2% bovine serum albumin in PBS and incubated with a biotinylated murine Penta His antibody (Qiagen). As secondary reagent a streptavidin alkaline phosphatase conjugate (DAKO) was used. Blots were developed with BCIP/NBT substrate solution (Pierce).

Figure 31:
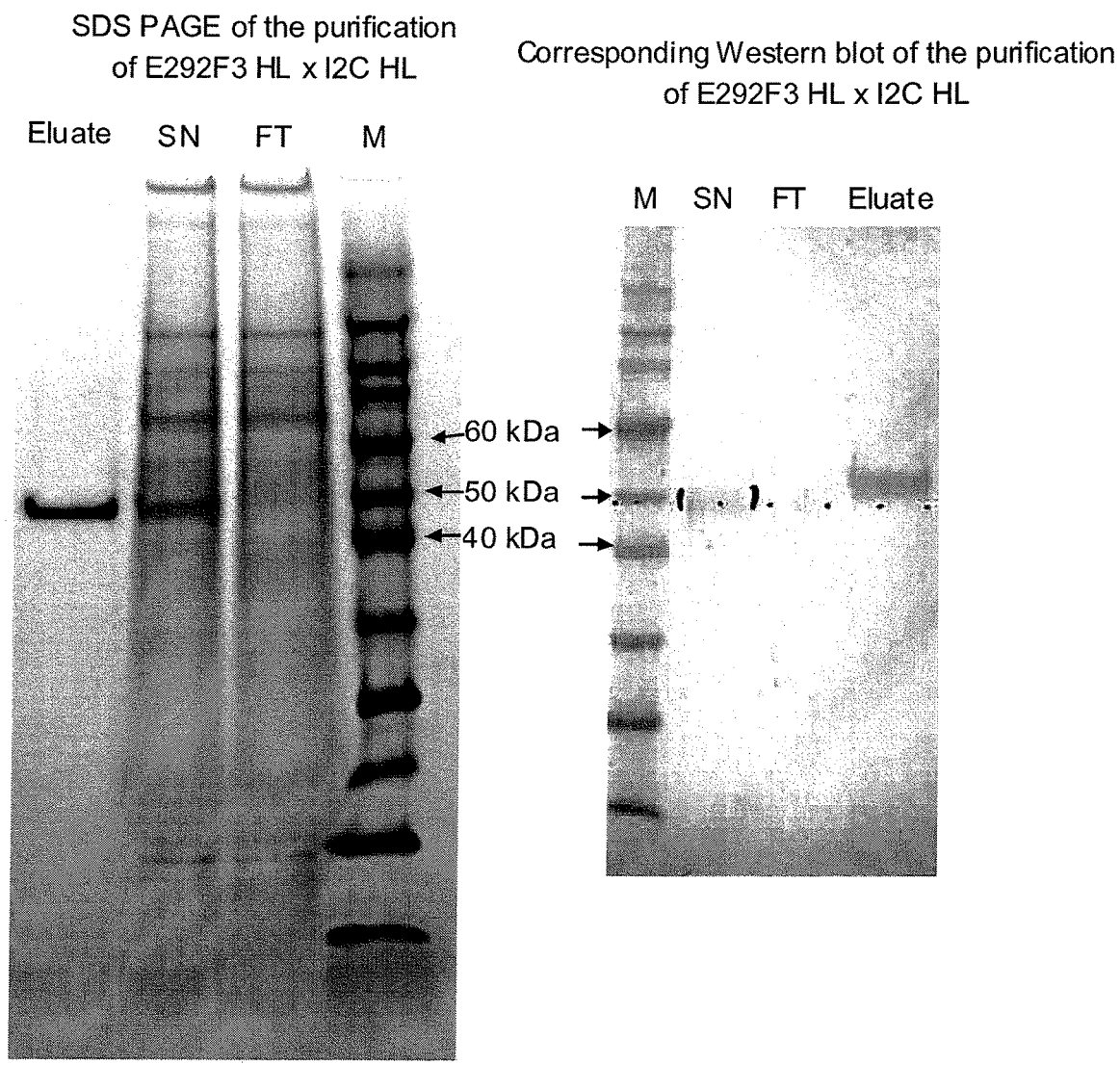

As demonstrated in FIGS. 31, 32 and 33 the use of a human CD3 peptide affinity column as described above allows the highly efficient purification of the bispecific single chain molecules from cell culture supernatant. The cross-species specific anti-CD3 single chain antibodies contained in the bispecific single chain molecules therefore enable via their specific binding properties an efficient generic one-step method of purification for the cross-species specific bispecific single chain molecules, without the need of any tags solely attached for purification purposes.

18. Generic Pharmacokinetic Assay for Cross-Species Specific Bispecific Single Chain Molecules 18.1 Production of 1-27 CD3-Fc for Use in the Pharmacokinetic Assay The coding sequence of the 1-27 N-terminal amino acids of the human CD3 epsilon chain fused to the hinge and Fc gamma region of human immunoglobulin IgG1 was obtained by gene synthesis according to standard protocols (cDNA sequence and amino acid sequence of the recombinant fusion protein are listed under SEQ ID NOs 309 and 310). The gene synthesis fragment was designed as to contain first a Kozak site for eukaryotic expression of the construct, followed by a 19 amino acid immunoglobulin leader peptide, followed in frame by the coding sequence of the first 27 amino acids of the extracellular portion of the mature human CD3 epsilon chain, followed in frame by the coding sequence of the hinge region and Fc gamma portion of human IgG1 and a stop codon. The gene synthesis fragment was also designed as to introduce restriction sites at the beginning and at the end of the cDNA coding for the fusion protein. The introduced restriction sites, EcoRI at the 5' end and SalI at the 3' end, were utilised in the following cloning procedures. The gene synthesis fragment was cloned via EcoRI and SalI into a plasmid designated pEF-DHFR (pEF-DHFR is described in Raum et al. Cancer Immunol Immunother 50 (2001) 141-150) following standard protocols. The afore-mentioned procedures were carried out according to standard protocols (Sambrook, Molecular Cloning; A Laboratory Manual, 3rd edition, Cold Spring Harbour Laboratory Press, Cold Spring Harbour, New York (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX. After two passages of stationary culture the cells were grown in roller bottles with nucleoside-free HyQ PF CHO™ liquid soy medium (with 4.0 mM L-Glutamine with 0.1% Pluronic F—68; HyClone) for 7 days before harvest. The cells were removed by centrifugation and the supernatant containing the expressed protein was stored at −20° C. For the isolation of the fusion protein a goat anti-human fc affinity column was prepared according to standard protocols using a commercially available affinity purified goat anti-human IgG fc fragment specific antibody with minimal cross-reaction to bovine, horse, and mouse serum proteins (Jackson ImmunoResearch Europe Ltd.). Using this affinity column the fusion protein was isolated out of cell culture supernatant on an Äkta® Explorer System (GE Amersham) and eluted by citric acid. The eluate was neutralized and concentrated.

18.2 Pharmacokinetic Assay for Cross-Species Specific Bispecific Single Chain Molecules The assay is based on the ECL-ELISA technology using ruthenium labelled detection on carbon plates measured on a SECTOR® Imager device (MSD). In a first step, carbon plates (MSD High Bind Plate 96 well Cat: L15×B-3) were coated with 5 µl/well at 50 ng/ml of the purified 1-27 CD3-Fc described in Example 18.1. The plate was then dried overnight at 25° C. Subsequently plates were blocked with 5% BSA (Paesel&Lorei #100568) in PBS at 150 µl/well for 1 h at 25° C. in an incubator while shaking (700 rpm). In the next step plates were washed three times with 0.05% TWEEN® in PBS. A standard curve in 50% macaque serum in PBS was generated by serial 1:4 dilution starting at 100 ng/ml of the respective cross-species specific bispecific single chain molecule to be detected in the assay. Quality control (QC) samples were prepared in 50% macaque serum in PBS ranging from 1 ng/ml to 50 ng/ml of the respective cross-species specific bispecific single chain molecule dependent on the expected sample serum concentrations. Standard, QC or unknown samples were transferred to the carbon plates at 10 µl/well and incubated for 90 min at 25° C. in the incubator while shaking (700 rpm). Subsequently plates were washed three times with 0.05% TWEEN® in PBS. For detection 25 µl/well of penta-His-Biotin antibody (Qiagen, 200 µg/ml in 0.05% TWEEN® in PBS) was added and incubated for 1 h at 25° C. in an incubator while shaking (700 rpm). In a second detection step 25 µl/well Streptavidin-SulfoTag solution (MSD; Cat: R32AD-1; Lot: W0010903) was added and incubated for 1 h at 25° C. in an incubator while shaking (700 rpm). Subsequently plates were washed three times with 0.05% TWEEN® in PBS. Finally 150 µl/well MSD® Read Buffer (MSD®, Cat: R9ZC-1) was added and plates were read in the SECTOR® Imager device.

FIGS. 34 and 35 demonstrate the feasibility of detection of cross-species specific bispecific single chain molecules in serum samples of macaque monkeys for cross-species specific bispecific single chain molecules. The cross-species specific anti-CD3 single chain antibodies contained in the bispecific single chain molecules enable therefore via their specific binding properties a highly sensitive generic assay for detection of the cross-species specific bispecific single chain molecules. The assay set out above can be used in the context of formal toxicological studies that are needed for drug development and can be easily adapted for measurement of patient samples in connection with the clinical application of cross-species specific bispecific single chain molecules.

19. Generation of Recombinant Transmembrane Fusion Proteins of the N-Terminal Amino Acids 1-27 of CD3 Epsilon from Different Non-Chimpanzee Primates Fused to EpCAM from Cynomolgus Monkey (1-27 CD3-EpCAM).

19.1 Cloning and Expression of 1-27 CD3-EpCAM

CD3 epsilon was isolated from different non-chimpanzee primates (marmoset, tamarin, squirrel monkey) and swine. The coding sequences of the 1-27 N-terminal amino acids of CD3 epsilon chain of the mature human, common marmoset (*Callithrix jacchus*), cottontop tamarin (*Saguinus oedipus*), common squirrel monkey (*Saimiri sciureus*) and domestic swine (*Sus scrofa*; used as negative control) fused to the N-terminus of Flag tagged cynomolgus EpCAM were obtained by gene synthesis according to standard protocols (cDNA sequence and amino acid sequence of the recombinant fusion proteins are listed under SEQ ID NOs 231 to 240). The gene synthesis fragments were designed as to contain first a BsrGI site to allow for fusion in correct reading frame with the coding sequence of a 19 amino acid immunoglobulin leader peptide already present in the target expression vector, which was followed in frame by the coding sequence of the N-terminal 1-27 amino acids of the extracellular portion of the mature CD3 epsilon chains, which was followed in frame by the coding sequence of a Flag tag and followed in frame by the coding sequence of the mature cynomolgus EpCAM transmembrane protein. The gene synthesis fragments were also designed to introduce a restriction site at the end of the cDNA coding for the fusion protein. The introduced restriction sites BsrGI at the 5' end and SalI at the 3' end, were utilized in the following cloning procedures. The gene synthesis fragments were then cloned via BsrGI and SalI into a derivative of the plasmid designated pEF-DHFR (pEF-DHFR is described in Raum et al. Cancer Immunol Immunother 50 (2001) 141-150), which already contains the coding sequence of the 19 amino acid immunoglobulin leader peptide following standard protocols. Sequence verified plasmids were used to transfect DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX.

Transfectants were tested for cell surface expression of the recombinant transmembrane protein via an FACS assay according to standard protocols. For that purpose a number of 2.5×10⁵ cells were incubated with 50 μl of the anti-Flag® M2 antibody (Sigma-Aldrich Chemie GmbH, Taufkirchen, Germany) at 5 μg/ml in PBS with 2% FCS. Bound antibody was detected with an R-Phycoerythrin-conjugated affinity purified F(ab')2 fragment, goat anti-mouse IgG, Fc-gamma fragment specific 1:100 in PBS with 2% FCS (Jackson ImmunoResearch Europe Ltd., Newmarket, Suffolk, UK). Flow cytometry was performed on a FACSCalibur™ apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

Figure 36:
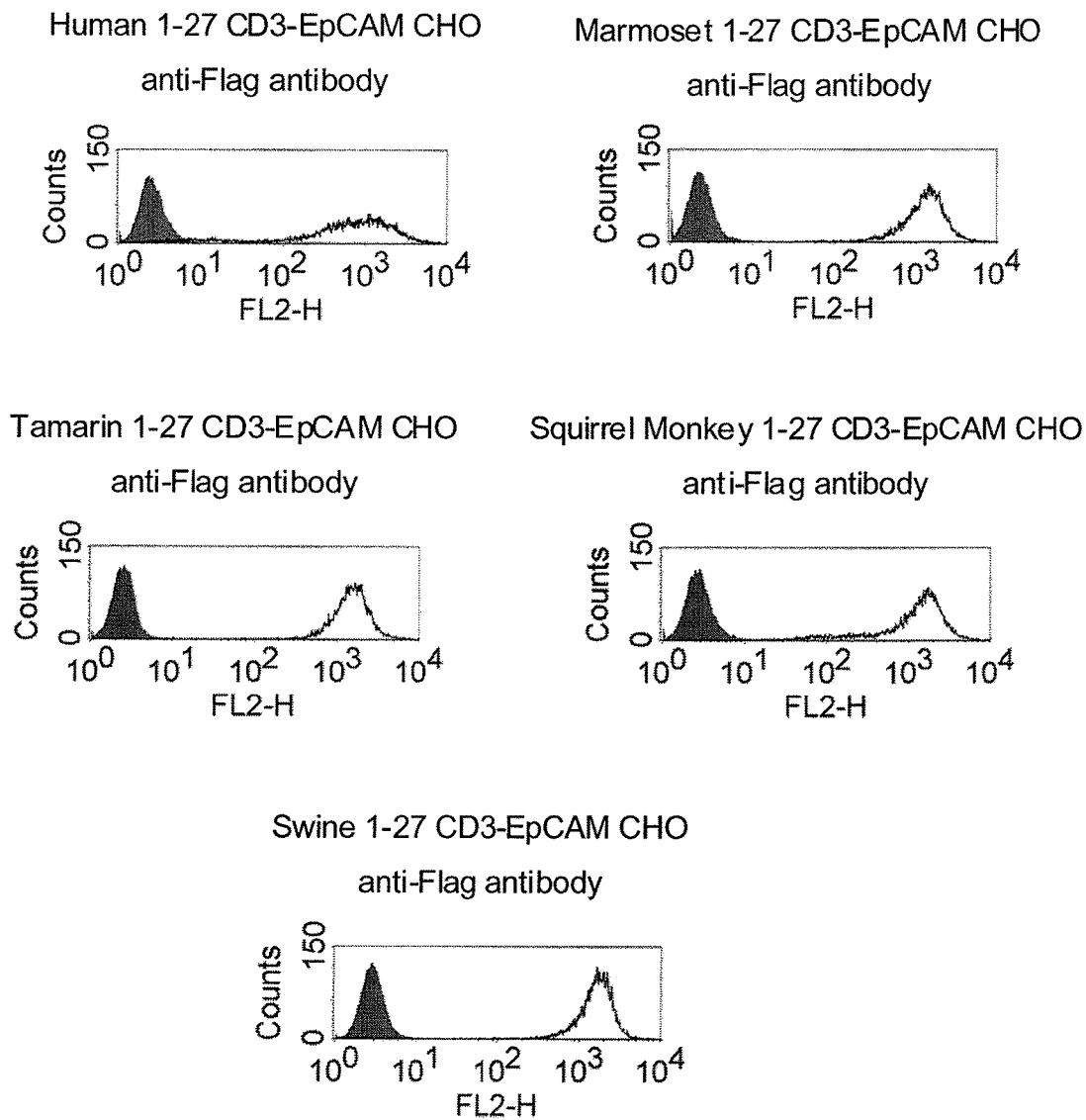

Expression of the Flag tagged recombinant transmembrane fusion proteins consisting of cynomolgus EpCAM and the 1-27 N-terminal amino acids of the human, marmoset, tamarin, squirrel monkey and swine CD3 epsilon chain respectively on transfected cells is clearly detectable (FIG. 36).

19.2 Cloning and Expression of the Cross-Species Specific Anti-CD3 Single Chain Antibody I2C HL in Form of an IgG1 Antibody In order to provide improved means of detection of binding of the cross-species specific single chain anti-CD3 antibody the I2C VHVL specificity is converted into an IgG1 antibody with murine IgG1 and murine kappa constant regions. cDNA sequences coding for the heavy chain of the IgG antibody were obtained by gene synthesis according to standard protocols. The gene synthesis fragments were designed as to contain first a Kozak site to allow for eukaryotic expression of the construct, which is followed by an 19 amino acid immunoglobulin leader peptide, which is followed in frame by the coding sequence of the heavy chain variable region or light chain variable region, followed in frame by the coding sequence of the heavy chain constant region of murine IgG1 as published in GenBank® (Accession number AB097849) or the coding sequence of the murine kappa light chain constant region as published in GenBank® (Accession number D14630), respectively.

Restriction sites were introduced at the beginning and the end of the cDNA coding for the fusion protein. Restriction sites EcoRI at the 5' end and SalI at the 3' end were used for the following cloning procedures. The gene synthesis fragments were cloned via EcoRI and SalI into a plasmid designated pEF-DHFR (pEF-DHFR is described in Raum et al. Cancer Immunol Immunother 50 (2001) 141-150) for the heavy chain construct and pEFADA (pEFADA is described in Raum et al. Cancer Immunol Immunother 50 (2001) 141-150) for the light chain construct according to standard protocols. Sequence verified plasmids were used for co-transfection of respective light and heavy chain constructs into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the constructs was induced by increasing concentrations of methotrexate (MTX) to a final concentration of up to 20 nM MTX and deoxycoformycin (dCF) to a final concentration of up to 300 nM dCF. After two passages of stationary culture cell culture supernatant was collected and used in the subsequent experiment.

19.3 Binding of the Cross-Species Specific Anti-CD3 Single Chain Antibody I2C HL in Form of an IgG1 Antibody to 1-27 CD3-EpCAM Binding of the generated I2C IgG1 construct to the 1-27 N-terminal amino acids of the human, marmoset, tamarin and squirrel monkey CD3 epsilon chains respectively fused to cynomolgus Ep-CAM as described in Example 19.1 was tested in a FACS assay according to standard protocols. For that purpose a number of 2.5×10⁵ cells were incubated with 50 μl of cell culture supernatant containing the I2C IgG1 construct as described in Example 19.2. The binding of the antibody was detected with an R-Phycoerythrin-conjugated affinity purified F(ab')2 fragment, goat anti-mouse IgG, Fc-gamma fragment specific, diluted 1:100 in PBS with 2% FCS (Jackson ImmunoResearch Europe Ltd., Newmarket, Suffolk, UK). Flow cytometry was performed on a FACSCalibur™ apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

Figure 37:
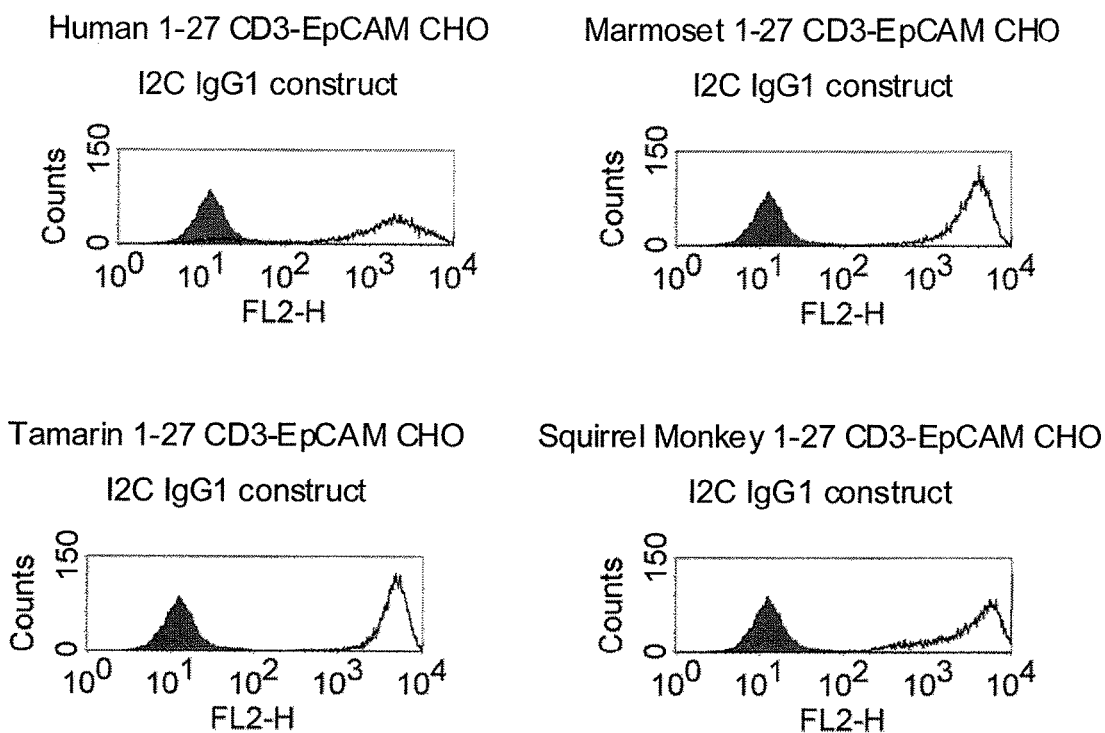
Figure 38:
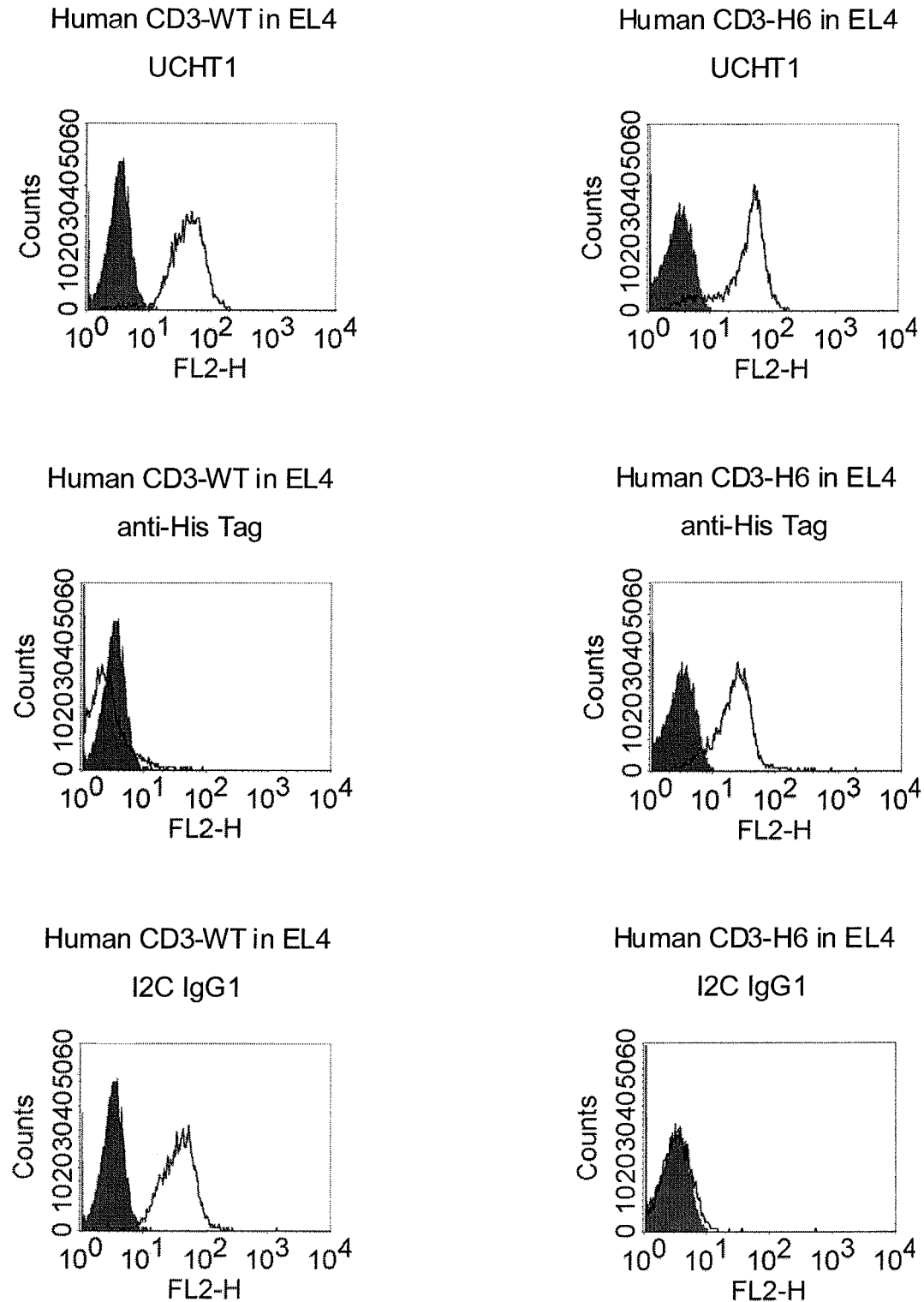

As shown in FIG. 37 binding of the I2C IgG1 construct to the transfectants expressing the recombinant transmembrane fusion proteins consisting of the 1-27 N-terminal amino acids of CD3 epsilon of human, marmoset, tamarin or squirrel monkey fused to cynomolgus EpCAM as compared to the negative control consisting of the 1-27 N-terminal amino acids of CD3 epsilon of swine fused to cynomolgus EpCAM was observed. Thus multi-primate cross-species specificity of I2C was demonstrated. Signals obtained with the anti Flag M2 antibody and the I2C IgG1 construct were comparable, indicating a strong binding activity of the cross-species specific specificity I2C to the N-terminal amino acids 1-27 of CD3 epsilon.

20. Binding of the Cross-Species Specific Anti-CD3 Binding Molecule I2C to the Human CD3 Epsilon Chain with and without N-Terminal His6 Tag A chimeric IgG1 antibody with the binding specificity I2C as described in Example 19.2 specific for CD3 epsilon was tested for binding to human CD3 epsilon with and without N-terminal His6 tag. Binding of the antibody to the EL4 cell lines transfected with His6-human CD3 epsilon as described in Example 6.1 and wild-type human CD3 epsilon as described in Example 5.1 respectively was tested by a FACS assay according to standard protocols. $2.5 \times 10^5$ cells of the transfectants were incubated with 50 µl of cell culture supernatant containing the I2C IgG1 construct or 50 µl of the respective control antibodies at 5 µg/ml in PBS with 2% FCS. As negative control an appropriate isotype control and as positive control for expression of the constructs the CD3 specific antibody UCHT-1 were used respectively. Detection of the His6 tag was performed with the penta His antibody (Qiagen). The binding of the antibodies was detected with a R-Phycoerythrin-conjugated affinity purified F(ab')2 fragment, goat anti-mouse IgG, Fc-gamma fragment specific, diluted 1:100 in PBS with 2% FCS (Jackson ImmunoResearch Europe Ltd., Newmarket, Suffolk, UK). Flow cytometry was performed on a FACSCalibur™ apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

Comparable binding of the anti-human CD3 antibody UCHT-1 to both transfectants demonstrates approximately equal levels of expression of the constructs. The binding of the penta His antibody confirmed the presence of the His6 tag on the His6-human CD3 construct but not on the wild-type construct.

Compared to the EL4 cell line transfected with wild-type human CD3 epsilon a clear loss of binding of the I2C IgG1 construct to human-CD3 epsilon with an N-terminal His6 tag was detected. These results show that a free N-terminus of CD3 epsilon is essential for binding of the cross-species specific anti-CD3 binding specificity I2C to the human CD3 epsilon chain (FIGS. 28A-28B).

21. Generation of CD33 and CD3 Cross-Species Specific Bispecific Single Chain Molecules 21.1 Generation of CD33 and CD3 cross-species specific bispecific single chain molecules Generally, bispecific single chain antibody molecules, each comprising a domain with a binding specificity cross-species specific for human and macaque CD3epsilon as well as a domain with a binding specificity cross-species specific for human and macaque CD33, were designed as set out in the following Table 6:

TABLE 6

Formats of anti-CD3 and anti-CD33 cross-species specific bispecific single chain antibody molecules

| SEQ ID (nucl/prot) | Formats of protein constructs (N → C) |
|---|---|
| 316/315 | I2CHLxAF5HL |
| 314/313 | F12QHLxAF5HL |
| 312/311 | H2CHLxAF5HL |

The aforementioned constructs containing the variable light-chain (L) and variable heavy-chain (H) domains cross-species specific for human and macaque CD33 and the CD3 specific VH and VL combinations cross-species specific for human and macaque CD3 were obtained by gene synthesis. The gene synthesis fragments were designed as to contain first a Kozak site for eukaryotic expression of the construct, followed by a 19 amino acid immunoglobulin leader peptide, followed in frame by the coding sequence of the respective bispecific single chain antibody molecule, followed in frame by the coding sequence of a histidine$_6$-tag and a stop codon. The gene synthesis fragment was also designed as to introduce suitable restriction sites at the beginning and at the end of the fragment. The introduced restriction sites were utilised in the following cloning procedures. The gene synthesis fragment was cloned via these restriction sites into a plasmid designated pEF-DHFR (pEF-DHFR is described in Raum et al. Cancer Immunol Immunother 50 (2001) 141-150) following standard protocols. The aforementioned procedures were carried out according to standard protocols (Sambrook, Molecular Cloning; A Laboratory Manual, 3rd edition, Cold Spring Harbour Laboratory Press, Cold Spring Harbour, New York (2001)). A clone with sequence-verified nucleotide sequence was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methotrexate (MTX) to a final concentration of up to 20 nM MTX. After two passages of stationary culture cell culture supernatant was collected and used in the subsequent experiments.

21.2 Flow Cytometric Binding Analysis of the CD33 and CD3 Cross-Species Specific Bispecific Antibodies In order to test the functionality of the cross-species specific bispecific antibody constructs regarding the capability to bind to human and macaque CD33 and CD3, respectively, a FACS analysis is performed. For this purpose CHO cells transfected with human CD33 as described in Example 16.1 and the human CD3 positive T cell leukemia cell line HPB-ALL (DSMZ, Braunschweig, ACC483) were used to test the binding to human antigens. The binding reactivity to macaque antigens was tested by using the generated macaque CD33 transfectant described in Example 16.2 and macaque PBMC (preparation of macaque PBMC was performed by Ficoll gradient centrifugation of peripheral blood from macaque monkeys according to standard protocols). 200,000 cells of the respective cell lines or PBMC were incubated for 30 min. on ice with 50 µl of cell culture supernatant of transfected cells expressing the cross-species specific bispecific antibody constructs. The cells were washed twice in PBS with 2% FCS and binding of the construct was detected with a murine anti-His antibody (Penta His antibody; Qiagen; diluted 1:20 in 50 µl PBS with 2% FCS). After washing, bound anti-His antibodies were detected with an Fc gamma-specific antibody (Dianova) conjugated to phycoerythrin, diluted 1:100 in PBS with 2% FCS. Supernatant of untransfected CHO cells was used as negative control.

Flow cytometry was performed on a FACSCalibur™ apparatus; the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

The bispecific binding of the single chain molecules listed above, which were cross-species specific for CD33 and cross-species specific for human and non-chimpanzee primate CD3 was clearly detectable as shown in FIGS. 41A-41B. In the FACS analysis all constructs showed binding to CD3 and CD33 as compared to the respective negative controls. Cross-species specificity of the bispecific antibodies to human and macaque CD3 and CD33 antigens was demonstrated.

21.3. Bioactivity of CD33 and CD3 Cross-Species Specific Bispecific Single Chain Antibodies Bioactivity of the generated bispecific single chain antibodies was analyzed by chromium 51 ($^{51}$Cr) release in vitro cytotoxicity assays using the CD33 positive cell lines described in Examples 16.1 and 16.2. As effector cells stimulated human CD4/CD56 depleted PBMC or the macaque T cell line 4119LnPx were used as specified in the respective figures.

A Petri dish (145 mm diameter, Greiner bio-one GmbH, Kremsmünster) was coated with a commercially available anti-CD3 specific antibody (e.g. OKT3, Orthoclone) in a final concentration of 1 µg/ml for 1 hour at 37° C. Unbound protein was removed by one washing step with PBS. The fresh PBMC were isolated from peripheral blood (30-50 ml human blood) by Ficoll gradient centrifugation according to standard protocols. 3-5×10$^7$ PBMC were added to the pre-coated Petri dish in 120 ml of RPMI 1640 with stabilized glutamine/10% FCS/IL-2 20 U/ml (Proleukin®, Chiron) and stimulated for 2 days. On the third day the cells were collected and washed once with RPMI 1640. IL-2 is added to a final concentration of 20 U/ml and the cells were cultivated again for one day in the same cell culture medium as above.

By depletion of CD4+ T cells and CD56+ NK cells according to standard protocols CD8+ cytotoxic T lymphocytes (CTLs) were enriched.

Target cells were washed twice with PBS and labelled with 11.1 MBq $^{51}$Cr in a final volume of 100 µl RPMI with 50% FCS for 45 minutes at 37° C. Subsequently the labelled target cells were washed 3 times with 5 ml RPMI and then used in the cytotoxicity assay. The assay was performed in a 96 well plate in a total volume of 250 µl supplemented RPMI (as above) with an E:T ratio of 10:1. Supernatant of cells expressing the cross-species specific bispecific single chain antibody molecules in a final concentration of 50% and 20 threefold dilutions thereof were applied. The assay time is 18 hours and cytotoxicity was measured as relative values of released chromium in the supernatant related to the difference of maximum lysis (addition of Triton®-X) and spontaneous lysis (without effector cells). All measurements were done in quadruplicates. Measurement of chromium activity in the supernatants was performed with a Wizard 3" (Wizard$^3$®) gamma counter (Perkin Elmer Life Sciences GmbH, Köln, Germany). Analysis of the experimental data was performed with Prism 4 for Windows (version 4.02, GraphPad Software Inc., San Diego, California, USA). Sigmoidal dose response curves typically have R$^2$ values >0.90 as determined by the software. EC$_{50}$ values calculated by the analysis program were used for comparison of bioactivity.

As shown in FIG. 42, all of the generated cross-species specific bispecific single chain antibody constructs demonstrate cytotoxic activity against human CD33 positive target cells elicited by stimulated human CD4/CD56 depleted PBMC and against macaque CD33 positive target cells elicited by the macaque T cell line 4119LnPx.

Figure 43:
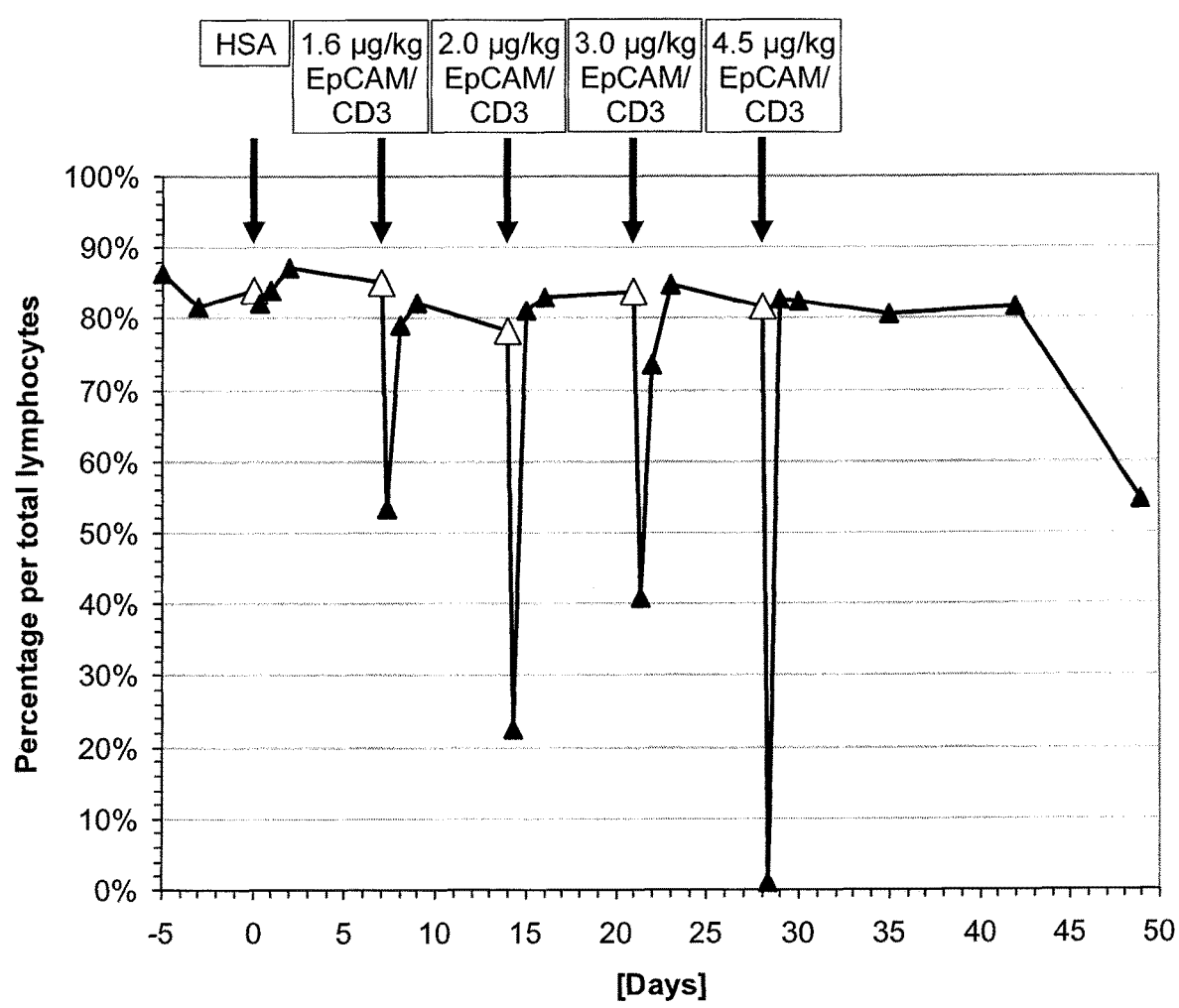

22. Redistribution of Circulating Chimpanzee T Cells Upon Exposure to a Conventional Bispecific CD3 Binding Molecule Directed at a Target Molecule which is Absent from Circulating Blood Cells A single male chimpanzee was subjected to dose escalation with intravenous single-chain EpCAM/CD3-bispecific antibody construct (Schlereth (2005) Cancer Res 65: 2882). Like in the conventional single-chain CD19/CD3-bispecific antibody construct (Loffler (2000, Blood, Volume 95, Number 6) or WO 99/54440), the CD3 arm of said EpCAM/CD3-construct is also directed against a conventional context dependent epitope of human and chimpanzee CD3. At day 0, the animal received 50 ml PBS/5% HSA without test material, followed by 50 ml PBS/5% HSA plus single-chain EpCAM/CD3-bispecific antibody construct at 1.6, 2.0, 3.0 and 4.5 µg/kg on days 7, 14, 21 and 28, respectively. The infusion period was 2 hours per administration. For each weekly infusion the chimpanzee was sedated with 2-3 mg/kg Telazol® intramuscularly, intubated and placed on isoflurane/O$_2$ anesthesia with stable mean blood pressures. A second intravenous catheter was placed in an opposite limb to collect (heparinized) whole blood samples at the time points indicated in FIG. 43 for FACS analysis of circulating blood cells. After standard erythrocyte lysis, T cells were stained with a FITC-labeled antibody reacting with chimpanzee CD2 (Becton Dickinson) and the percentage of T cells per total lymphocytes determined by flowcytometry. As shown in FIG. 43, every administration of single-chain EpCAM/CD3-bispecific antibody construct induced a rapid drop of circulating T cells as observed with single-chain CD19/CD3-bispecific antibody construct in B-NHL patients, who had essentially no circulating target B (lymphoma) cells. As there are no EpCAM-positive target cells in the circulating blood of humans and chimpanzees, the drop of circulating T cells upon exposure to the single-chain EpCAM/CD3-bispecific antibody construct can be attributed solely to a signal, which the T cells receive through pure interaction of the CD3 arm of the construct with a conventional context dependent CD3 epitope in the absence of any target cell mediated crosslinking. Like the redistribution of T cells induced through their exposure to single-chain CD19/CD3-bispecific antibody construct in B-NHL patients, who had essentially no circulating target B (lymphoma) cells, the T cell redistribution in the chimpanzee upon exposure to the single-chain EpCAM/CD3-bispecific antibody construct can be explained by a conformational change of CD3 following the binding event to a context dependent CD3 epitope further resulting in the transient increase of T cell adhesiveness to blood vessel endothelium (see Example 13). This finding confirms, that conventional CD3 binding molecules directed to context dependent CD3 epitopes—solely through this interaction—can lead to a redistribution pattern of peripheral blood T cells, which is associated with the risk of CNS adverse events in humans as describe in Example 13.

23. Specific Binding of scFv Clones to the N-Terminus of Human CD3 Epsilon 23.1 Bacterial Expression of scFv Constructs in *E. coli* XL1 Blue As previously mentioned, *E. coli* XL1 Blue transformed with pComb3H5Bhis/Flag containing a VL- and VH-segment produce soluble scFv in sufficient amounts after excision of the gene III fragment and induction with 1 mM IPTG. The scFv-chain is exported into the periplasma where it folds into a functional conformation.

The following scFv clones were chosen for this experiment:

i) ScFvs 4-10, 3-106, 3-114, 3-148, 4-48, 3-190 and 3-271 as described in WO 2004/106380.
ii) ScFvs from the human anti-CD3epsilon binding clones H₂C, F12Q and I2C as described herein.

For periplasmic preparations, bacterial cells transformed with the respective scFv containing plasmids allowing for periplasmic expression were grown in SB-medium supplemented with 20 mM MgCl2 and carbenicillin 50 μg/ml and redissolved in PBS after harvesting. By four rounds of freezing at −70° C. and thawing at 37° C., the outer membrane of the bacteria was destroyed by osmotic shock and the soluble periplasmic proteins including the scFvs were released into the supernatant. After elimination of intact cells and cell-debris by centrifugation, the supernatant containing the human anti-human CD3-scFvs was collected and used for further examination. These crude supernatants containing scFv will be further termed periplasmic preparations (PPP).

23.2 Binding of scFvs to Human CD3 Epsilon (Aa 1-27)-Fc Fusion Protein

ELISA experiments were carried out by coating the human CD3 epsilon (aa 1-27)-Fc fusion protein to the wells of 96 well plastic plates (Nunc, maxisorb) typically at 4° C. over night. The antigen coating solution was then removed, wells washed once with PBS/0.05% TWEEN® 20 and subsequently blocked with PBS/3% BSA for at least one hour. After removal of the blocking solution, PPPs and control solutions were added to the wells and incubated for typically one hour at room temperature. The wells were then washed three times with PBS/0.05% TWEEN® 20. Detection of scFvs bound to immobilized antigen was carried out using a Biotin-labeled anti FLAG-tag antibody (M2 anti Flag-Bio, Sigma, typically at a final concentration of 1 μg/ml PBS) and detected with a peroxidase-labeled Streptavidine (Dianova, 1 μg/ml PBS). The signal was developed by adding ABTS substrate solution and measured at a wavelength of 405 nm. Unspecific binding of the test-samples to the blocking agent and/or the human IgG1 portion of the human CD3 epsilon (aa 1-27)-Fc fusion protein was examined by carrying out the identical assay with the identical reagents and identical timing on ELISA plates which were coated with human IgG1 (Sigma). PBS was used as a negative control.

Figure 44:
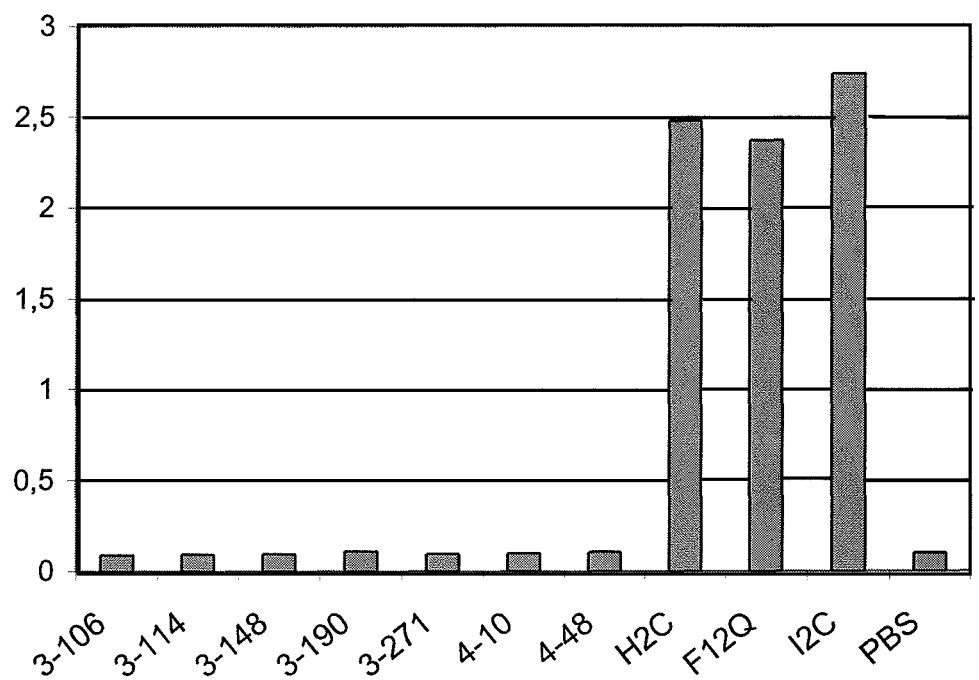

As shown in FIG. 44, scFvs H₂C, F12Q and I2C show strong binding signals on human CD3 epsilon (aa 1-27)-Fc fusion protein. The human scFvs 3-106, 3-114, 3-148, 3-190, 3-271, 4-10 and 4-48 (as described in WO 2004/106380) do not show any significant binding above negative control level.

Figure 45:
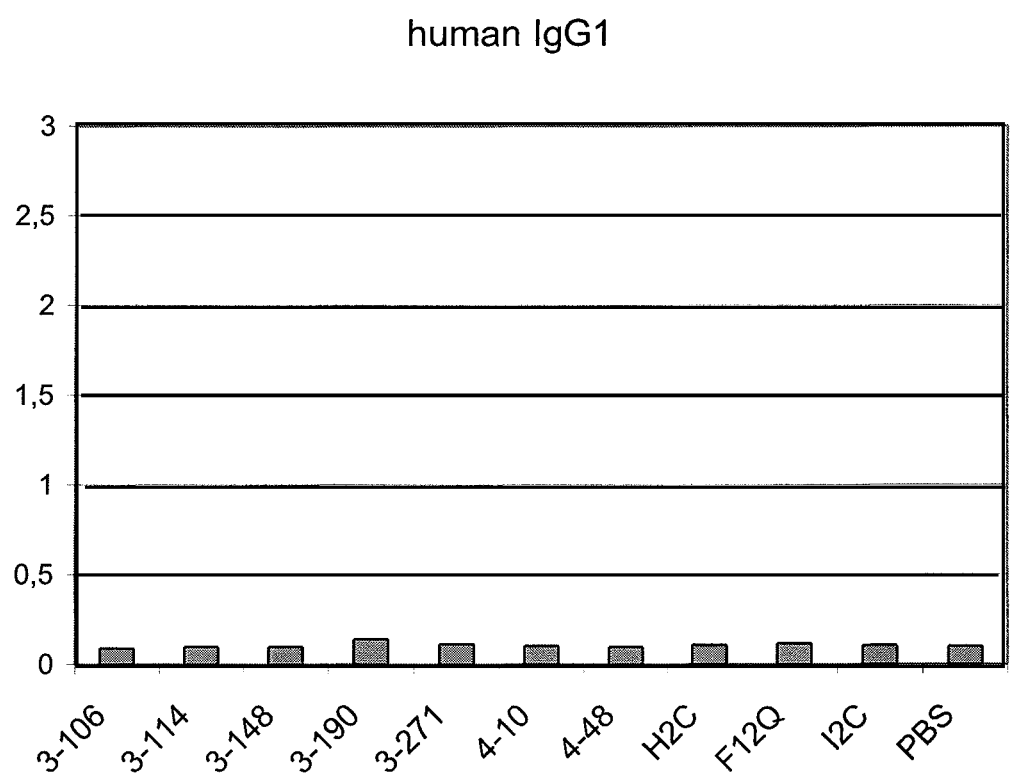

To exclude the possibility that the positive binding of scFvs H₂C, F12Q and I2C to wells coated with human CD3 epsilon (aa 1-27)-Fc fusion protein might be due to binding to BSA (used as a blocking agent) and/or the human IgG1 Fc-gamma-portion of the human CD3 epsilon (aa 1-27)-Fc fusion protein, a second ELISA experiment was performed in parallel. In this second ELISA experiment, all parameters were identical to those in the first ELISA experiment, except that in the second ELISA experiment human IgG1 (Sigma) was coated instead of human CD3 epsilon (aa 1-27)-Fc fusion protein. As shown in FIG. 45, none of the scFvs tested showed any significant binding to BSA and/or human IgG1 above background level.

Taken together, these results allow the conclusion that conventional CD3 binding molecules recognizing a context-dependent epitope of CD3 epsilon (e.g. as disclosed in WO 2004/106380) do not bind specifically to the human CD3 epsilon (aa 1-27)-region, whereas the scFvs H₂C, F12Q and I2C binding a context-independent epitope of CD3 epsilon clearly show specific binding to the N-terminal 27 amino acids of human CD3 epsilon.

24. Generation and Characterization of Single Domain EGFR and CD3 Cross-Species Specific Bispecific Single Chain Molecules 24.1 Generation of CHO Cells Transfected with Human EGFR The cell line positive for human EGFR, A431 (epidermoid carcinoma cell line, CRL-1555, American Type Culture Collection, Rockville, MD) was used to obtain total RNA that was isolated according to the instructions of the kit manual (Qiagen, RNeasy Mini Kit, Hilden, Germany). The obtained RNA was used for cDNA synthesis by random-primed reverse transcription. For cloning of the full length sequence of the human EGFR antigen the following oligonucleotides were used:

```
5' EGFR AG XbaI
                                  (SED ID NO 402)
5'-GGTCTAGAGCATGCGACCCTCCGGGACGGCCGGG-3'

3' EGFR AG SalI
                                  (SEQ ID NO 403)
5'-TTTTAAGTCGACTCATGCTCCAATAAATTCACTGCT-3'
```

The coding sequence was amplified by PCR (denaturation at 94° C. for 5 min, annealing at 58° C. for 1 min, elongation at 72° C. for 2 min for the first cycle; denaturation at 94° C. for 1 min, annealing at 58° C. for 1 min, elongation at 72° C. for 2 min for 30 cycles; terminal extension at 72° C. for 5 min). The PCR product was subsequently digested with XbaI and SalI, ligated into the appropriately digested expression vector pEF-DHFR (Raum et al., Cancer Immunol. Immunother. 2001; 50: 141-150), and transformed into *E. coli*. The afore-mentioned procedures were carried out according to standard protocols (Sambrook, Molecular Cloning; A Laboratory Manual, 3rd edition, Cold Spring Harbour Laboratory Press, Cold Spring Harbour, New York (2001)). A clone with sequence-verified nucleotide sequence (SEQ ID 370, Amino acid sequence SEQ ID 369) was transfected into DHFR deficient CHO cells for eukaryotic expression of the construct. Eukaryotic protein expression in DHFR deficient CHO cells was performed as described by Kaufmann R. J. (1990) Methods Enzymol. 185, 537-566. Gene amplification of the construct was induced by increasing concentrations of methothrexate (MTX) to a final concentration of up to 20 nM MTX.

24.2 Generation of CHO Cells Expressing the Extracellular Domain of Macaque EGFR The cDNA sequence of the extracellular domain of macaque EGFR was obtained by a set of two PCRs on macaque monkey colon cDNA (Cat #: C1534090-Cy-BC; obtained from BioCat GmbH, Heidelberg, Germany) using the following reaction conditions: 1 cycle at 94° C. for 3 minutes followed by 35 cycles with 94° C. for 1 minute, 53° C. for 1 minute and 72° C. for 2 minutes followed by a terminal cycle of 72° C. for 3 minutes. The following primers were used:

```
4. forward primer:
                                        (SEQ ID NO 404)
5'-CGCTCTGCCCGGCGAGTCGGGC-3' reverse primer:
                                        (SEQ ID NO 405)
5'-CCGTCTTCCTCCATCTCATAGC-3'

5. forward primer:
                                        (SEQ ID NO 406)
5'-ACATCCGGAGGTGACAGATCACGGCTCGTGC-3' reverse primer:
                                        (SEQ ID NO 407)
5'-CAGGATATCCGAACGATGTGGCGCCTTCGC-3'
```

Those PCRs generated two overlapping fragments (A: 1-869, B: 848-1923), which were isolated and sequenced according to standard protocols using the PCR primers, and thereby provided a 1923 bp portion of the cDNA sequence of macaque EGFR from the third nucleotide of codon +1 of the mature protein to the $21^{st}$ codon of the transmembrane domain. To generate a construct for expression of macaque EGFR a cDNA fragment was obtained by gene synthesis according to standard protocols (the cDNA and amino acid sequence of the construct is listed under SEQ ID Nos 372 and 371). In this construct the coding sequence for macaque EGFR from amino acid +2 to +641 of the mature EGFR protein was fused into the coding sequence of human EGFR replacing the coding sequence of the amino acids +2 to +641. The gene synthesis fragment was also designed as to contain a Kozak site for eukaryotic expression of the construct and restriction sites at the beginning and the end of the cDNA coding for essentially the extracellular domain of macaque EGFR fused to the transmembrane and intracellular domains of human EGFR. Furthermore a conservative mutation was introduced at amino acid 627 ($4^{th}$ amino acid of the transmembrane domain) mutating valine into leucine to generate a restriction site (SphI) for cloning purposes. The introduced restriction sites XbaI at the 5' end and SalI at the 3' end, were utilised in the following cloning procedures. The gene synthesis fragment was then cloned via XbaI and SalI into a plasmid designated pEF-DHFR (pEF-DHFR is described in Mack et al. Proc. Natl. Acad. Sci. USA 92 (1995) 7021-7025). A sequence verified clone of this plasmid was used to transfect CHO/dhfr-cells as described above.

24.3 Cloning of Cross-Species Specific Single Domain Binding Molecules

Generally, bispecific single chain antibody molecules, each comprising a domain with a binding specificity cross-species specific for human and non-chimpanzee primate CD3 epsilon as well as a domain with a binding specificity cross-species specific for human and non-chimpanzee primate EGFR, were designed as set out in the following Table 7:

TABLE 7

Formats of anti-CD3 and anti-EGFR cross-species specific single domain bispecific single chain antibody molecules

| SEQ ID (nucl/prot) | Formats of protein constructs (N → C) |
|---|---|
| 381/380 | EGFR 3D-E8 x I2C HL |
| 385/384 | EGFR 3D-E8 x F12Q HL |
| 383/382 | EGFR 3D-E8 x H2C HL |
| 392/391 | EGFR 3D-D12 x I2C HL |
| 396/395 | EGFR 3D-D12 x F12Q HL |
| 394/393 | EGFR 3D-D12 x H2C HL |

The aforementioned constructs containing the variable chain cross-species specific for human and macaque EGFR and CD3 were obtained by gene synthesis. The gene synthesis fragments were designed as to contain first a Kozak site for eukaryotic expression of the construct, followed by a 19 amino acid immunoglobulin leader peptide, followed in frame by the coding sequence of the respective bispecific single chain antibody molecule, followed in frame by the coding sequence of a 6 histidine tag and a stop codon. The gene synthesis fragment was also designed as to introduce suitable restriction sites at the beginning and at the end of the fragment. The introduced restriction sites were utilized in the following cloning procedures. The gene synthesis fragment was also designed as to introduce suitable N- and C-terminal restriction sites. The gene synthesis fragment was cloned via these restriction sites into a plasmid designated pEF-DHFR (pEF-DHFR is described in Raum et al. Cancer Immunol Immunother 50 (2001) 141-150) according to standard protocols (Sambrook, Molecular Cloning; A Laboratory Manual, 3rd edition, Cold Spring Harbour Laboratory Press, Cold Spring Harbour, New York (2001)). A clone with sequence-verified nucleotide sequence was transfected into dihydrofolate reductase (DHFR) deficient Chinese hamster ovary (CHO) cells for eukaryotic expression of the construct.

The constructs were transfected stably or transiently into DHFR-deficient CHO-cells (ATCC® No. CRL 9096) by electroporation or alternatively into HEK 293 (human embryonal kidney cells, ATCC® Number: CRL-1573) in a transient manner according to standard protocols.

24.4. Expression and Purification of the Single Domain Bispecific Single Chain Antibody Molecules The single domain bispecific single chain antibody molecules were expressed in chinese hamster ovary cells (CHO). Eukaryotic protein expression in DHFR deficient CHO cells was performed as described by Kaufmann R. J. (1990) Methods Enzymol. 185, 537-566. Gene amplification of the constructs was induced by increasing final concentrations of MTX up to 20 nM. After two passages of stationary culture the cells were grown in roller bottles with nucleoside-free HyQ PF CHO™ liquid soy medium (with 4.0 mM L-Glutamine with 0.1% Pluronic F—68; HyClone) for 7 days before harvest. The cells were removed by centrifugation and the supernatant containing the expressed protein was stored at −20° C. Alternatively, constructs were transiently expressed in HEK 293 cells. Transfection was performed with 293Fectin™ reagent (Invitrogen, #12347-019) according to the manufacturer's protocol.

Äkta® Explorer System (GE Health Systems) and Unicorn® Software were used for chromatography. Immobilized metal affinity chromatography ("IMAC") was performed using a Fractogel EMD Chelate® (Merck) which was loaded with ZnCl2 according to the protocol provided by the manufacturer. The column was equilibrated with buffer A (20 mM sodium phosphate buffer pH 7.2, 0.1 M NaCl) and the cell culture supernatant (500 ml) was applied to the column (10 ml) at a flow rate of 3 ml/min. The column was washed with buffer A to remove unbound sample. Bound protein was eluted using a two step gradient of buffer B (20 mM sodium phosphate buffer pH 7.2, 0.1 M NaCl, 0.5 M Imidazol) according to the following:

Step 1: 20% buffer B in 6 column volumes
Step 2: 100% buffer B in 6 column volumes Eluted protein fractions from step 2 were pooled for further purification. All chemicals were of research grade and purchased from Sigma (Deisenhofen) or Merck (Darmstadt).

Gel filtration chromatography was performed on a HiLoad 16/60 Superdex® 200 prep grade column (GE/Amersham) equilibrated with Equi-buffer (25 mM Citrat, 200 mM Lysin, 5% Glycerol, pH 7.2). Eluted protein samples (flow rate 1 ml/min) were subjected to standard SDS-PAGE and Western Blot for detection. Prior to purification, the column was calibrated for molecular weight determination (molecular weight marker kit, Sigma MW GF-200). Protein concentrations were determined using OD280 nm.

Purified bispecific single chain antibody protein was analyzed in SDS PAGE under reducing conditions performed with pre-cast 4-12% Bis Tris gels (Invitrogen). Sample preparation and application were performed according to the protocol provided by the manufacturer. The molecular weight was determined with MultiMark® protein standard (Invitrogen). The gel was stained with colloidal Coomassie (Invitrogen protocol). The purity of the isolated protein was >95% as determined by SDS-PAGE. Western Blot was performed using an Optitran® BA-S83 membrane and the Invitrogen Blot Module according to the protocol provided by the manufacturer. The antibodies used were directed against the His Tag (Penta His, Qiagen) and Goat-anti-mouse Ig labeled with alkaline phosphatase (AP) (Sigma), and BCIP/NBT (Sigma) as substrate.

24.5. Flow Cytometric Binding Analysis of the EGFR and CD3 Cross-Species Specific Single Domain Bispecific Antibodies In order to test the functionality of the single domain cross-species specific bispecific antibody constructs with regard to binding capability to human and macaque EGFR and CD3, respectively, a FACS analysis was performed. For this purpose CHO cells transfected with human EGFR as described in Example 24.1 and human CD3 positive T cell leukemia cell line Jurkat (DSMZ, Braunschweig, ACC 282) were used to test the binding to human antigens. The binding reactivity to macaque antigens was tested by using the generated macaque EGFR transfectant described in Example 24.2 and a macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61). 200.000 cells of the respective cell population were incubated for 30 min on ice with 50 µl of the purified protein of the cross-species specific bispecific antibody constructs (2 µg/ml). Alternatively, the cell culture supernatant of transiently produced proteins was used. The cells were washed twice in PBS and binding of the construct was detected with a murine Penta His antibody (Qiagen; diluted 1:20 in 50 µl PBS with 2% FCS). After washing, bound His antibodies were detected with an Fc gamma-specific antibody (Dianova) conjugated to phycoerythrin, diluted 1:100 in PBS with 2% FCS. Fresh culture medium was used as a negative control.

Flow cytometry was performed on a FACSCalibur™ apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

The binding ability of several single domain bispecific single chain molecules which are specific for EGFR and cross-species specific for human and non-chimpanzee primate CD3 were clearly detectable as shown in FIG. 46/1 and FIG. 46/2 In the FACS analysis, all constructs showed binding to CD3 and EGFR compared to culture medium and first and second detection antibody as the negative controls. Cross-species specificity of the bispecific antibody to human and macaque CD3 and EGFR antigens was demonstrated.

24.6. Bioactivity of EGFR and CD3 Cross-Species Specific Single Domain Bispecific Single Chain Antibodies Bioactivity of the generated single domain bispecific single chain antibodies was analyzed by chromium 51 ($^{51}$Cr) release in vitro cytotoxicity assays using the EGFR positive cell lines described in Examples 24.1 and 24.2. As effector cells stimulated human CD8 positive T cells or the macaque T cell line 4119LnPx were used, respectively.

Stimulated CD8+ T cells were obtained as follows:

A Petri dish (145 mm diameter, Greiner) was pre-coated with a commercially available anti-CD3 specific antibody in a final concentration of 1 µg/ml for 1 hour at 37° C. Unbound protein was removed by one washing step with PBS. The fresh PBMC's were isolated from peripheral blood (30-50 ml human blood) by Ficoll gradient centrifugation according to standard protocols. 3-5×10$^7$ PBMCs were added to the precoated petri dish in 120 ml of RPMI 1640/10% FCS/IL-2 20 U/ml (Proleukin®, Chiron) and stimulated for 2 days. At the third day the cells were collected, washed once with RPMI 1640. IL-2 was added to a final concentration of 20 U/ml and cultivated again for one day. CD8+ cytotoxic T lymphocytes (CTLs) were isolated by depletion of CD4+ T cells and CD56+ NK cells.

Target cells were washed twice with PBS and labeled with 11.1 MBq $^{51}$Cr in a final volume of 100 µl RPMI with 50% FCS for 45 minutes at 37° C. Subsequently the labeled target cells were washed 3 times with 5 ml RPMI and then used in the cytotoxicity assay. The assay was performed in a 96 well plate in a total volume of 250 µl supplemented RPMI (as above) with an E:T ratio of 10:1. 1 µg/ml of the cross-species specific bispecific single chain antibody molecules and 20 threefold dilutions thereof were applied. Alternatively cell culture supernatant of transiently produced proteins was serially diluted in 1:2 steps. The assay time is 18 hours and cytotoxicity was measured as relative values of released chromium in the supernatant related to the difference of maximum lysis (addition of Triton®-X) and spontaneous lysis (without effector cells). All measurements were done in quadruplicates. Measurement of chromium activity in the supernatants was performed with a Wizard 3" (Wizard$^3$®) gamma counter (Perkin Elmer Life Sciences GmbH, Köln, Germany). Analysis of the experimental data was performed with Prism 4 for Windows (version 4.02, GraphPad Software Inc., San Diego, California, USA). Sigmoidal dose response curves typically had R2 values >0.90 as determined by the software. EC50 values calculated by the analysis program were used for comparison of bioactivity.

As shown in FIGS. 47/1 and FIG. 47/2 all of the generated single domain cross-species specific bispecific single chain antibody constructs revealed cytotoxic activity against human EGFR positive target cells elicited by human CD8+ cells and macaque EGFR positive target cells elicited by the macaque T cell line 4119LnPx. A bispecific single chain antibody with different target specificity was used as negative control.

25 Generation of Cross-Species Specific Bispecific Single Chain Molecules Comprising One or Two Single-Domain Antibody Binders 25 A) Generation of Cross-Species Specific Single Domain Antibodies Binding to the N-Terminal Amino Acids 1-27 of CD3epsilon of Man and Different Non-Chimpanzee Primates 25 A1) Preparation of Peptide Conjugates of the N-Terminal Amino Acids 1-27 of CD3epsilon of Man to KLH and BSA for Immunization 18 mg of a lyophilized peptide of the sequence acetyl-QDGNEEMGGITQTPYKVSISGTTVILTC (the additional amino acid "C" at the C-terminal position is added for coupling the 1-27 amino acid construct to e.g. KLH; SEQ ID NO 425) obtained by peptide synthesis according to standard protocols was dissolved in Dimethylformamide (DMF) and then diluted in phosphate buffered saline with 1 mM ethylenediaminetetraacetic acid (PBS/EDTA) resulting in a final concentration of 10% DMF to keep the peptide dissolved. This peptide solution was applied onto a Reduce-Imm™ Reducing Column (Pierce, Rockford IL). Activation and washing of the column as well as all subsequent steps were performed according to the protocol of the manufacturer. The peptide solution was applied to the column and eluted resulting in the reductive cleavage of the disulphide bond between the C-terminal cysteines of two peptides generating a free cysteine on every peptide. One half of the reduced peptide solution was mixed with 6 mg of maleimide activated bovine serum albumin BSA (Pierce, Rockford IL). The remaining peptide solution was mixed with 6 mg of maleimide activated keyhole limpet hemocyanin KLH (Pierce, Rockford IL). Conjugation was performed for 2 hours at room temperature under agitation and protection from light. Afterwards both conjugates were dialyzed three times against PBS according to standard protocols to achieve a physiological formulation.

25 A2) Immunization of Camelids Using the N-Terminus of CD3 Epsilon Separated from its Native CD3-Context by Fusion to a Heterologous Soluble Protein as Well as Conjugation to KLH 1 to 8 years old Alpaca/Llama crossings were immunized with the CD3epsilon-Fc fusion protein carrying the most N-terminal amino acids 1-27 of the mature CD3epsilon chain (1-27 CD3-Fc) of man, the CD3epsilon-Fc fusion protein carrying the most N-terminal amino acids 1-27 of the mature CD3epsilon chain (1-27 CD3-Fc) of *Saimiri sciureus*, a peptide-BSA conjugate of the most N-terminal amino acids 1-27 of the mature CD3epsilon chain (1-27 CD3-Fc) of man and a peptide-KLH conjugate of the most N-terminal amino acids 1-27 of the mature CD3epsilon chain (1-27 CD3-Fc) of man all as described above. To this end for each animal 500 µg of a 1:1 mixture of the two 1-27 CD3-Fc fusion proteins in a total volume of 2 ml PBS were mixed with 1 ml complete Freund's adjuvant and injected subcutaneously. The animals received booster immunizations after 28 and 42 days and optionally also after 56, 70 and 84 days. The first booster immunization was performed with 500 µg of a 1:1 mixture of the two 1-27 CD3-Fc fusion proteins in a total volume of 2 ml PBS mixed with 1 ml incomplete Freund's adjuvant and injected subcutaneously. The second and all following booster immunizations were performed alternately with 500 µg of peptide-KLH conjugate and peptide-BSA conjugate described above diluted with PBS to a final volume of 2 ml mixed with 1 ml incomplete Freund's adjuvant and injected subcutaneously.

52 days after the first immunization, blood samples were taken and antibody serum titers against the CD3-positive human T cell line HPB-ALL and the macaque CD3-positive T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) were tested in flow cytometry according to standard protocols. To this end 200.000 cells of the respective cell lines were incubated for 30 min on ice with 50 µl of serum of the immunized animals diluted 1:1000 in PBS with 2% FCS. The cells were washed twice in PBS with 2% FCS and binding of serum antibodies was detected with a FITC conjugated Goat anti-Llama IgG-H&L Antibody (Bethyl Laboratories Inc., Catalog No. A160-100F) diluted 1:100 in 50 µl PBS with 2% FCS. Serum of the animals obtained prior to immunization was used as a negative control.

Flow cytometry was performed on a FACSCalibur™ apparatus, the CellQuest software was used to acquire and analyze the data (Becton Dickinson biosciences, Heidelberg). FACS staining and measuring of the fluorescence intensity were performed as described in Current Protocols in Immunology (Coligan, Kruisbeek, Margulies, Shevach and Strober, Wiley-Interscience, 2002).

Figure 48:
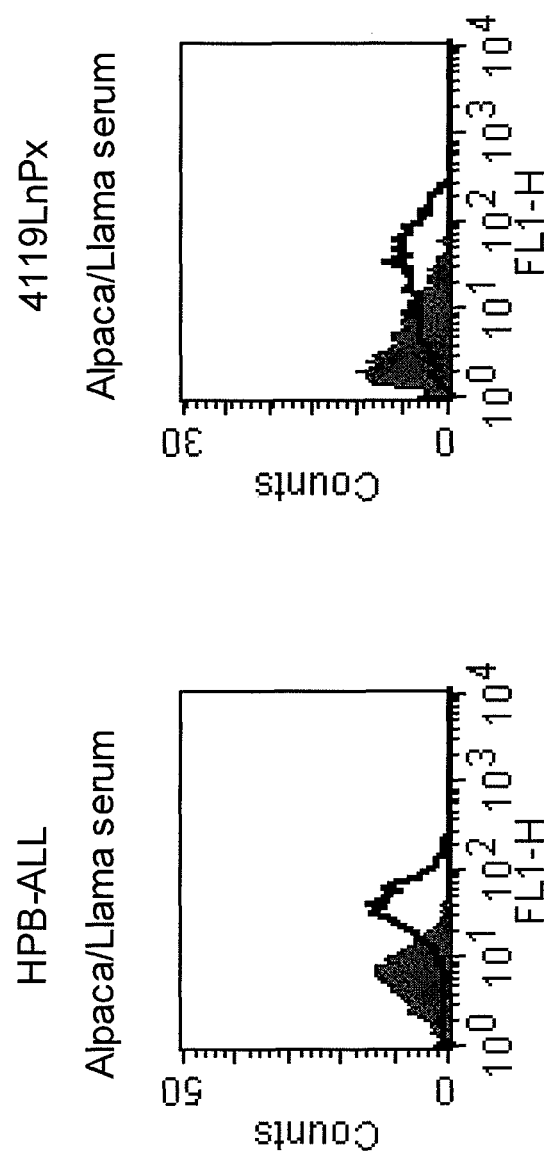

Reactivity to the CD3-positive human T cell line HPB-ALL and the CD3-positive macaque T cell line 4119LnPx of a serum sample of one exemplary animal obtained 52 days after the first immunization was clearly detectable as shown in FIG. 48.

25 A3) Generation of an Immune Camelid Single Domain Antibody Library: Construction of an Antibody Library and Phage Display Hundred milliliter of peripheral blood were obtained from each of three animals with antigen-positive serum titers. Peripheral blood mononuclear cells (PBMCs) were isolated by a ficoll-gradient according to standard methods. Total RNA was isolated from the PBMCs using the RNeasy® Midi Kit (QIAGEN) following the manufacturer's instructions. cDNA was synthesized according to standard methods (Sambrook, Cold Spring Harbor Laboratory Press 1989, Second Edition).

For the isolation of V-region DNA, RT-PCR was carried out using a specific primer set consisting of the 5' primers:

```
5'-VHHa-XhoI:
                                   (SEQ ID NO 408)
5'-CTG ACG CTC GAG GAG GTG CAG CTG GTG GAG TCT
GG-3',

5'-VHHb-XhoI:
                                    SEQ ID NO 409)
5'-CTG ACG CTC GAG CAG GTR CAG CTG GTG GAG TCT
GG-3'

5'-VHHc-XhoI:
                                   (SEQ ID NO 410)
5'-CTG ACG CTC GAG CAG GTA AAG CTG GAG GAG TCT
GG-3'

5'-VHHd-XhoI:
                                   (SEQ ID NO 411)
5'-CTG ACG CTC GAG GAT GTG CAG CTG GTG GAG TCT
GG-3'

5'-VHHe-XhoI:
                                   (SEQ ID NO 412)
5'-CTG ACG CTC GAG GCC GTG CAG CTG GTG GAT TCT
GG-3'
```

-continued

5'-VHHf-XhoI:
(SEQ ID NO 413)
5'-CTG ACG CTC GAG GCG GTG CAG CTG GTG GAG TCT
GG-3'

5'-VHH-LP-A-XhoI:
(SEQ ID NO 414)
5'-CTG ACG CTC GAG GAG GTG CAG CTG CAG GCG TCT
G-3'

5'-VHH-LP-B-XhoI:
(SEQ ID NO 415)
5'-CTG ACG CTC GAG GAT GTS CAG CTG CAG GCG TCT
G-3'

5'-VHH-LX-I-XhoI:
(SEQ ID NO 416)
5'-CTG ACG CTC GAG CAG GTG CAG CTG GTG CAG TCT
GG-3'

5'-VHH-LX-II-XhoI:
(SEQ ID NO 417)
5'-CTG ACG CTC GAG CAG GTC ACC TTG AAG GAG TCT
GG-3'

5'-VHH-LX-III-XhoI:
(SEQ ID NO 418)
5'-CTG ACG CTC GAG CAG GTG CAG CTG CAG GAG TCG
GG-3'

5'-VHH-LG-1-XhoI:
(SEQ ID NO 419)
5'-CTG ACG CTC GAG CTG CAG CAG TCT GGG GGA GG-3'
and of the 3'-primers:
3'-VHHG2-BsiWI-SpeI:
(SEQ ID NO 420)
5'-CTG ACG ACT AGT CGT ACG TTG GGG TAT CTT GGG
TTC TG-3'

3'-VHHG3-BsiWI-SpeI:
(SEQ ID NO 421)
5'-CTG ACG ACT AGT CGT ACG TAC TTC ATT CGT TCC
TGA VGA G-3'

3'-VHH-LP-G2a-BsiWI-SpeI:
(SEQ ID NO 422)
5'-CTG ACG ACT AGT CGT ACG TTG TGG TTT TGG
TGT CTT GGG TTC-3'

3'-VHH-LP-dirA-BsiWI-SpeI:
(SEQ ID NO 423)
5'-CTG ACG ACT AGT CGT ACG TGA GGA GAC GGT
GAC CTG GGT CC-3'

3'-VHH-LG-dir1-BsiWI-SpeI:
(SEQ ID NO 424)
5'-CTG ACG ACT AGT CGT ACG GGT GAC CTG GGT
CCC CTG GC-3'

The primers chosen for PCR amplification gave rise to 5'-XhoI and 3'-SpeI recognition sites for the V chain fragments. Per PCR reaction, one specific 5'-primer was combined with one specific 3'-primer. The number of different PCR reactions was determined by the number of possible combinations of 5'—and 3'-primers. The following PCR-program was used for amplification: Denaturation at 94° C. for 15 seconds, primer annealing at 52° C. for 50 seconds and primer extension at 72° C. for 90 seconds were performed over 40 cycles, followed by final extension at 72° C. for 10 minutes. DNA V-fragments were then isolated according to standard protocols.

300 ng of the V chain fragments (XhoI-SpeI digested) were ligated with 1400 ng of the phagemid pComb3H5Bhis (XhoI-SpeI digested; large fragment). The resulting antibody library was then transformed into 300 ul of electrocompetent *Escherichia coli* XL1 Blue cells by electroporation (2.5 kV, 0.2 cm gap cuvette, 25 uFD, 200 Ohm, Biorad gene-pulser) resulting in a library size of more than 10E7 independent clones. After one hour of phenotype expression and slow adaptation to carbenicillin, the *E. coli* cells containing the antibody library were transferred into SB-Carbenicillin (50 ug/mL) selection medium. The *E. coli* cells containing the antibody library were then infected with an infectious dose of 10E12 particles of helper phage VCSM13 resulting in the production and secretion of filamentous M13 phage. The resulting library comprises phage particles, which contain single stranded pComb3H5BHis-DNA encoding a camelid V-fragment and display the corresponding V-protein as a translational fusion to phage coat protein III. This pool of phages displaying the antibody library was later used for the selection of antigen binding entities.

25 A4) Phage Display Based Selection of CD3-Specific Single-Domain Binders

The phage library carrying the cloned V-repertoire was harvested from the respective culture supernatant by PEG8000/NaCl precipitation and centrifugation. Approximately 10E11 to 10E12 scFv phage particles were resuspended in 0.4 ml of PBS/0.1% BSA and incubated with 10E5 to 10E7 HPB-ALL cells (a CD3-positive human T-cell line) for 1 hour on ice under slow agitation. These Jurkat cells were grown beforehand in RPMI medium enriched with fetal calf serum (10%), glutamine and penicillin/streptomycin, harvested by centrifugation, washed in PBS and resuspended in PBS/1% FCS (containing Na Azide). Phage particles which do not specifically bind to the Jurkat cells via the displayed V domain were eliminated by up to five washing steps with PBS/1% FCS (containing Na Azide). After washing, specifically bound phages were eluted from the cells by resuspending the cells in HCl-glycine pH 2.2 (10 min incubation with subsequent vortexing) and after neutralization with 2 M Tris pH 12, the eluate was used for infection of a fresh uninfected *E. coli* XL1 Blue culture (OD600>0.5). The *E. coli* culture containing *E. coli* cells successfully transduced with a phagemid copy, encoding a V-fragment, were again selected for carbenicillin resistance and subsequently infected with VCMS 13 helper phage to start the second round of antibody display and in vitro selection. A total of 4 to 5 rounds of selections were carried out. Every second round of selection was performed using macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) instead of Jurkat cells.

25 A5) Screening for CD3-Specific Single-Domain Binders

Plasmid DNA corresponding to 4 and 5 rounds of panning was isolated from *E. coli* cultures after selection. For the production of soluble V protein, V DNA fragments were excised from the plasmids (XhoI-SpeI). These fragments were cloned via the same restriction sites into the plasmid pComb3H5BFlag/His differing from the original pComb3H5BHis in that the expression construct (i.e. V domain) includes a Flag-tag (TGD YKDDDDK SEQ ID NO. 433) at ot's C-terminus before the His6-tag and that phage protein III/N2 domain and protein III/CT had been deleted. After ligation, each pool (different rounds of panning) of plasmid DNA was transformed into 100 μl heat shock competent *E. coli* TG1 or XLI blue and plated onto carbenicillin LB-agar. Single colonies were picked into 100 ul of LB carb (50 ug/ml).

*E. coli* transformed with pComb3H5BHis containing a V-segment produce soluble V domains in sufficient amounts after excision of the gene III fragment and induction with 1 mM IPTG. Due to a suitable signal sequence, the V-chain was exported into the periplasma where it folds into a functional conformation.

Single *E. coli* TG1 bacterial colonies from the transformation plates were picked for periplasmic small scale preparations and grown in SB-medium (e.g. 10 ml) supplemented with 20 mM MgCl2 and carbenicillin 50 µg/ml (and re-dissolved in PBS (e.g. 1 ml) after harvesting. By four rounds of freezing at −70° C. and thawing at 37° C., the outer membrane of the bacteria was destroyed by temperature shock and the soluble periplasmic proteins including the V domains were released into the supernatant.

After elimination of intact cells and cell-debris by centrifugation, the supernatant containing the anti-CD3 single-domain antibodies was collected and used for further examination.

25 A6) Identification of CD3-Specific Single-Domain Binders

Binding of the isolated single-domain antibodies to human and non-chimpanzee primate CD3 was tested by flowcytometry on the human CD3 positive T cell leukemia cell line HPB-ALL (DSMZ, Braunschweig, ACC483) and the CD3 positive macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61).

Figure 49:
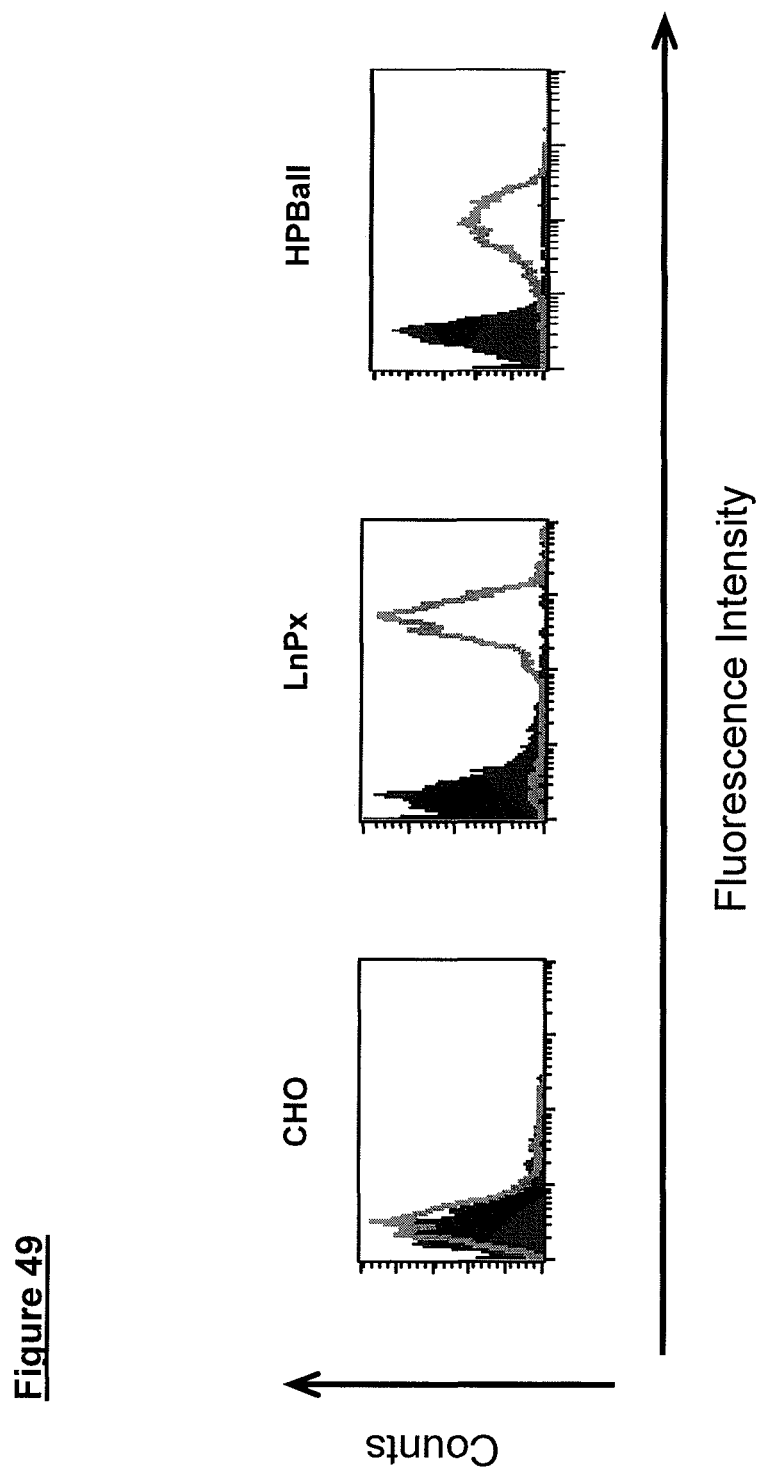

For flow cytometry $2.5 \times 10^5$ cells are incubated with 50 ul supernatant or with 5 µg/ml of the purified constructs in 50 µl PBS with 2% FCS. The binding of the constructs was detected with an anti-His antibody (Penta-His Antibody, BSA free, Qiagen GmbH, Hilden, FRG) at 2 µg/ml in 50 µl PBS with 2% FCS. As a second step reagent a R-Phycoerythrin-conjugated affinity purified F(ab')2 fragment, goat anti-mouse IgG (Fc-gamma fragment specific), diluted 1:100 in 50 µl PBS with 2% FCS (Dianova, Hamburg, FRG) was used. The samples were measured on a FACScan™ (BD biosciences, Heidelberg, FRG). FIG. 49 shows cross-species specific binding of anti-CD3 single domain binder CD3 3D-H11 to human and macaque T cells and no binding to CD3 negative CHO cells.

25 A7) Binding Assay of Cross-Species Specific Single Chain Antibodies to the N-Terminus of CD3epsilon (Amino Acids 1-27) Separated from its Native CD3-Context in a Soluble Fc-Fusion Protein and Conjugated as 27Mer-Peptide to BSA.

Figure 50:
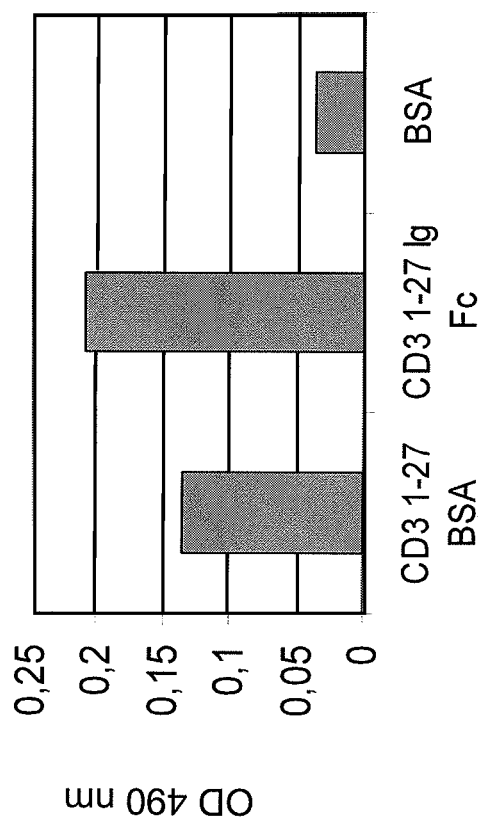

Binding of crude preparations of periplasmatically expressed anti-CD3 single domain antibody CD3 3D-$H_{11}$ to immobilized 1-27 CD3-Fc fusion protein and 1-27 CD3 BSA conjugate was tested in an ELISA assay. Antigen immobilization was carried out by overnight incubation of 5 µg/ml antigen in PBS at 4° C. Wells were washed with PBS containing 0.05% TWEEN® 20 (PBS/Tween) and blocked with PBS containing 3% BSA (bovine Albumin, fraction V, Sigma-Aldrich Chemie GmbH, Taufkirchen, Germany) for 60 minutes at RT. Subsequently, wells were incubated with crude preparations of periplasmatically expressed single domain antibody as described above for 60 minutes at room temperature. After washing with PBS/Tween wells were incubated with peroxidase conjugated anti-Flag® M2 antibody (Sigma-Aldrich Chemie GmbH, Taufkirchen, Germany) diluted 1:10000 in PBS with 1% BSA for 60 minutes at RT. Wells were washed with PBS/Tween and incubated with 100 µl of the SIGMAFAST™ OPD (OPD [o-Phenylenediamine dihydrochloride] substrate solution (Sigma-Aldrich Chemie GmbH, Taufkirchen, Germany) according to the manufacturers protocol. Color reaction was stopped with 100 µl 1 M $H_2SO_4$ and measured on a PowerWaveX™ microplate spectrophotometer (BioTek Instruments, Inc., Winooski, Vermont, USA) at 490 nm and subtraction of background absorption at 620 nm. Binding of anti-CD3 single domain antibody H11 to 1-27 CD3-Fc fusion protein as well as to 1-27 CD3 BSA conjugate is shown in FIG. 50

25 A8) Generation of Human/Humanized Equivalents of Non-Human CD3epsilon Specific Single-Domain Binders The camelid V region was aligned against human antibody germline amino acid sequences. The human antibody germline VH sequence was chosen which has the closest homology to the non-human V domain and a direct alignment of the two amino acid sequences was performed. There were a number of framework residues of the non-human V domain that differ from the human VH framework regions ("different framework positions"). Some of these residues may contribute to the binding and activity of the antibody to its target.

To construct a library that contains the non-human CDRs and at every framework position that differs from the chosen human VH sequence both possibilities (the human and the non-human amino acid residue), degenerated oligonucleotides were synthesized. These oligonucleotides incorporate at the differing positions the human residue with a probability of 75% and the non-human residue with a probability of 25%. For one human V domain e.g. six of these oligonucleotides had to be synthesized that overlap in a terminal stretch of approximately 20 nucleotides. To this end every second primer was an antisense primer. Restriction sites needed for later cloning of the V region had to be avoided within the nucleotide sequence of these oligonucleotides, e.g. by means of silent (i.e. amino acid neutral) nucleotide exchange if required.

These primers may have a length of 60 to 90 nucleotides, depending on the number of primers needed to span over the whole V sequence.

These e.g. six primers were mixed in equal amounts (e.g. 1 µl of each primer (primer stocks 20 to 100 µM) to a 20 µl PCR reaction) and added to a PCR mix consisting of PCR buffer, nucleotides and Taq polymerase. This mix was incubated at 94° C. for 3 minutes, 65° C. for 1 minute, 62° C. for 1 minute, 59° C. for 1 minute, 56° C. for 1 minute, 52° C. for 1 minute, 50° C. for 1 minute and at 72° C. for 10 minutes in a PCR cycler. Subsequently the product was run in an agarose gel electrophoresis and the product of a size from 200 to 400 isolated from the gel according to standard methods.

This PCR product was then used as a template for a standard PCR reaction using primers that incorporate N-terminal and C-terminal suitable cloning restriction sites. The DNA fragment of the correct size (for a V domain approximately 350 nucleotides) was isolated by agarose gel electrophoresis according to standard methods. In this way sufficient V domain DNA fragment was amplified. This V domain DNA fragment contained a pool of human-like V domains differing from each other by the number of human and non-human residues at the framework positions which originally differed between the human and the non-human V region.

The pool of human-like V domains was then cloned into the phage display vector pComb3H5Bhis to form a library of functional V domains from which—after display on filamentous phage—anti-CD3 binders were selected, screened, identified and confirmed as described above for the parental non-human (camelid) anti-CD3 V domain. Single clones were then analyzed for favorable properties and amino acid sequence. Those V domains which were closest in amino acid sequence homology to human germline V-segments are preferred.

Anti-CD3 single-domain binders are converted into recombinant bispecific single chain antibodies and further characterized as follows.

25 B) Generation and Characterization of Cross-Species Specific Bispecific Single Chain Molecules Comprising One or Two Single-Domain Antibody Binders 25 B1) Construction and Expression of Bispecific Single Chain Molecules Comprising One or Two Single-Domain Antibody Binders Anti-CD3 single-domain binders are converted into recombinant bispecific single chain antibodies by joining them via a Gly4Ser1-linker (SEQ ID NO: 431) with a target antigen specific single domain (V) or scFv-binder (VH-VL or VL-VH) to result in constructs with the following arrangements of three or two domains: $VH_{Target}$—$(Gly_4Ser_1)_3$ (i.e., GGGGSGGGGSGGGGS—SEQ ID NO: 435)—$VL_{Target}$—$Gly_4Ser_1$ (SEQ ID NO: 431)—$V_{CD3}$, or $V_{Target}$—$Gly_4Ser_1$ (SEQ ID NO: 431)—$V_{CD3}$. Alternatively, further constructs with different domain arrangements like $V_{CD3}$—$Gly_4Ser_1$—$VH_{Target}$—$(Gly_4Ser_1)_3$—$VL_{Target}$ or $V_{CD3}$—$Gly_4Ser_1$ (SEQ ID NO: 431)—$V_{Target}$ or constructs using a scFv-binder in VL-VH instead of VH-VL orientation can be generated according to standard protocols. For expression in CHO cells the coding sequences of (i) an N-terminal immunoglobulin heavy chain leader comprising a start codon embedded within a Kozak consensus sequence and (ii) a C-terminal His6 (i.e., HHHHHH (SEQ ID NO: 436))-tag followed by a stop codon are both attached in frame to the nucleotide sequence encoding the bispecific single chain antibodies prior to insertion of the resulting DNA-fragment as obtained by gene synthesis into the multiple cloning site of the expression vector pEF-DHFR (Raum et al. Cancer Immunol Immunother 50 (2001) 141-150). A clone with sequence-verified nucleotide sequence is transfected into DHFR deficient CHO cells for eukaryotic expression of the construct. Eukaryotic protein expression in DHFR deficient CHO cells is performed as described by Kaufmann R. J. (1990) Methods Enzymol. 185, 537-566. Gene amplification of the construct is induced by increasing concentrations of methotrexate (MTX) to a final concentration of up to 20 nM MTX.

25 B2) Production and Purification of Single Domain Bispecific Single Chain Antibody Molecules After two passages of stationary culture CHO cells expressing single domain bispecific single chain antibody molecules are grown in roller bottles with nucleoside-free HyQ PF CHO™ liquid soy medium (with 4.0 mM L-Glutamine with 0.1% Pluronic F—68; HyClone) for 7 days before harvest. The cells are removed by centrifugation and the supernatant containing the expressed protein is stored at −20° C. Transfection is performed with 293Fectin™ reagent (Invitrogen, #12347-019) according to the manufacturer's protocol.

Äkta® Explorer System (GE Health Systems) and Unicorn® Software are used for chromatography. Immobilized metal affinity chromatography ("IMAC") is performed using a Fractogel EMD Chelate® (Merck) which is loaded with ZnCl2 according to the protocol provided by the manufacturer. The column is equilibrated with buffer A (20 mM sodium phosphate buffer pH 7.2, 0.1 M NaCl) and the cell culture supernatant (500 ml) is applied to the column (10 ml) at a flow rate of 3 ml/min. The column is washed with buffer A to remove unbound sample. Bound protein is eluted using a two step gradient of buffer B (20 mM sodium phosphate buffer pH 7.2, 0.1 M NaCl, 0.5 M Imidazol) according as follows:

Step 1: 20% buffer B in 6 column volumes
Step 2: 100% buffer B in 6 column volumes Eluted protein fractions from step 2 are pooled for further purification. All chemicals can be used in research grade and purchased from Sigma (Deisenhofen) or Merck (Darmstadt).

Gel filtration chromatography is performed on a HiLoad 16/60 Superdex® 200 prep grade column (GE/Amersham) equilibrated with Equi-buffer (25 mM Citrat, 200 mM Lysin, 5% Glycerol, pH 7.2). Eluted protein samples (flow rate 1 ml/min) are subjected to standard SDS-PAGE and Western Blot for detection. Prior to purification, the column is calibrated for molecular weight determination (molecular weight marker kit, Sigma MW GF-200). Protein concentrations are determined using OD280 nm.

Purified bispecific single chain antibody protein is analyzed in SDS PAGE under reducing conditions performed with pre-cast 4-12% Bis Tris gels (Invitrogen). Sample preparation and application are performed according to the protocol provided by the manufacturer. The molecular weight is determined with MultiMarko protein standard (Invitrogen). The gel is stained with colloidal Coomassie (Invitrogen protocol). The purity of the isolated protein usually is >95% as determined by SDS-PAGE.

Western Blot is performed using an Optitran® BA-S83 membrane and the Invitrogen Blot Module according to the protocol provided by the manufacturer. For detection an anti-His Tag-antibody (Penta His, Qiagen) and Goat-anti-mouse Ig labeled with alkaline phosphatase (AP) (Sigma) are used; BCIP/NBT (Sigma) is used as substrate.

25 B3) Flow Cytometric Binding Analysis of Single Domain Bispecific Single Chain Antibody Molecules In order to test the functionality of the single domain cross-species specific bispecific antibody constructs with regard to binding capability to human and macaque target antigen and CD3, respectively, a FACS analysis is performed. For this purpose CHO cells transfected with the human (and optionally with the macaque) target antigen, the human CD3 positive T cell leukemia cell line Jurkat (DSMZ, Braunschweig, ACC 282) and the macaque T cell line 4119LnPx (kindly provided by Prof Fickenscher, Hygiene Institute, Virology, Erlangen-Nuernberg; published in Knappe A, et al., and Fickenscher H., Blood 2000, 95, 3256-61) are used. 200.000 cells of the respective cell population are incubated for 30 min on ice with 50 µl of the purified protein of the cross-species specific bispecific antibody constructs (2 µg/ml). Alternatively, the cell culture supernatant of CHO cells expressing the bispecific constructs can be used. The cells are washed twice in PBS and binding of the construct is detected with a murine Penta His antibody (Qiagen; diluted 1:20 in 50 µl PBS with 2% FCS). After washing, bound anti His antibodies are detected with an Fc gamma-specific antibody (Dianova) conjugated to phycoerythrin, diluted 1:100 in PBS with 2% FCS. Fresh culture medium is used as a negative control.

Flow cytometry is performed on a FACSCalibur™ apparatus, the CellQuest software is used to acquire and analyze the data (Becton Dickinson biosciences, Heidelberg). FACS staining and measuring of the fluorescence intensity are performed as described in Current Protocols in Immunology (Coligan, Kruisbeek, Margulies, Shevach and Strober, Wiley-Interscience, 2002).

25. B4) Cytotoxic Activity of Single Domain Bispecific Single Chain Antibody Molecules Bioactivity of the generated single domain bispecific single chain antibodies is analyzed by chromium 51 ($^{51}$Cr) release in vitro cytotoxicity assays using target antigen transfected CHO cells and—as effector cells—stimulated human CD8 positive T cells and the macaque T cell line 4119LnPx.

Stimulated CD8+ T cells are obtained as follows:

A Petri dish (145 mm diameter, Greiner) is pre-coated with a commercially available anti-CD3 specific antibody in a final concentration of 1 μg/ml for 1 hour at 37° C. Unbound protein is removed by one washing step with PBS. The fresh PBMC's are isolated from peripheral blood (30-50 ml human blood) by Ficoll gradient centrifugation according to standard protocols. 3-5×10$^7$ PBMCs are added to the pre-coated petri dish in 120 ml of RPMI 1640/10% FCS/IL-2 20 U/ml (Proleukin®, Chiron) and stimulated for 2 days. At the third day the cells are collected, washed once with RPMI 1640. IL-2 is added to a final concentration of 20 U/ml and cultivated again for one day. CD8+ cytotoxic T lymphocytes (CTLs) are isolated by depletion of CD4+ T cells and CD56+ NK cells.

Target cells are washed twice with PBS and labeled with 11.1 MBq $^{51}$Cr in a final volume of 100 μl RPMI with 50% FCS for 45 minutes at 37° C. Subsequently the labeled target cells are washed 3 times with 5 ml RPMI and then used in the cytotoxicity assay. The assay is performed in a 96 well plate in a total volume of 250 μl supplemented RPMI (as above) with an E:T ratio of 10:1. 1 μg/ml of the cross-species specific bispecific single chain antibody molecules and 20 threefold dilutions thereof are applied. Alternatively cell culture supernatant of CHO cell expressing the bispecific construct can be serially diluted in 1:2 steps. The assay duration is 18 hours and the cytotoxicity is measured as relative values of released chromium in the supernatant related to the difference of maximum lysis (addition of Triton®-X) and spontaneous lysis (without effector cells). All measurements are usually done in quadruplicates. Measurement of released chromium activity in the supernatants is performed with a Wizard 3" (Wizard$^3$®) gamma counter (Perkin Elmer Life Sciences GmbH, Koln, Germany). Analysis of the experimental data is performed with Prism 4 for Windows (version 4.02, GraphPad Software Inc., San Diego, California, USA). Sigmoidal dose response curves typically have $R^2$ values >0.90 as determined by the software. EC50 values calculated by the analysis program are used for comparison of bioactivity.

Only those constructs showing potent induction of T cell cytotoxicity against target cells are selected for further use.

| SEQ ID NO. | DESIGNATION | SOURCE | TYPE | SEQUENCE |
|---|---|---|---|---|
| 1. | Human CD3ε extracellular domain | human | aa | QDGNEEMGGITQTPYKVSISGTTVTLTCPQYPGSEILWQHNDKNIGGDEDDKNIGSDEDHLSLKE FSELEQSGYYVCYPRGSKPEDANFYLYLRARVCENCMEMD |
| 2. | Human CD3ε 1-27 | human | aa | QDGNEEMGGITQTPYKVSISGTTVTLT |
| 3. | Callithrix jacchus CD3ε extracellular domain | Callithrix jacchus | aa | QDGNEEMGDTTQNPYKVSISGTTVTLTCPRYDGHEIKWLVNSQNKEGHEDHLLLEDFSEMEQSGY YACLSKETPAEEASHYLYLKARVCENCVEVD |
| 4. | Callithrix jacchus CD3ε 1-27 | Callithrix jacchus | aa | QDGNEEMGDTTQNPYKVSISGTTVTLT |
| 5. | Saguinus oedipus CD3ε extracellular domain | Saguinus oedipus | aa | QDGNEEMGDTTQNPYKVSISGTTVTLTCPRYDGHEIKWLVNSQNKEGHEDHLLLEDFSEMEQSGY YACLSKETPAEEASHYLYLKARVCENCVEVD |
| 6. | Saguinus oedipus CD3ε 1-27 | Saguinus oedipus | aa | QDGNEEMGDTTQNPYKVSISGTTVTLT |
| 7. | Saimiri sciureus CD3ε extracellular domain | Saimiri sciureus | aa | QDGNEEIGDTTQNPYKVSISGTTVTLTCPRYDGQEIKWLVNDQNKEGHEDHLLLEDFSEMEQSGY YACLSKETPEEASHYLYLKARVCENCVEVD |
| 8. | Saimiri sciureus CD3ε 1-27 | Saimiri sciureus | aa | QDGNEEIGDTTQNPYKVSISGTTVTLT |
| 9. | CDR-L1 of F6A | artificial | aa | GSSTGAVTSGYYPN |
| 10. | CDR-L2 of F6A | artificial | aa | GTKFLAP |
| 11. | CDR-L3 of F6A | artificial | aa | ALWYSNRWV |
| 12. | CDR-H1 of F6A | artificial | aa | IYAMN |
| 13. | CDR-H2 of F6A | artificial | aa | RIRSKYNNYATYYADSVKS |
| 14. | CDR-H3 of F6A | artificial | aa | HGNFGNSYVSFFAY |
| 15. | VH of F6A | artificial | aa | EVQLVESGGGLVQPGGSLKLSCAASGFTFNIYAMNWVRQAPGKGLEWVARIRSKYNNYATYYADS VKSRFTISRDDSKNTAYLQMNNLKTEDTAVYYCVRHGNFGNSYVSFFAYWGQGTLVTVSS |
| 16. | VH of F6A | artificial | nt | GAGGTGCAGCTGGTCGAGTCTGGAGGAGGATTGGTGCAGCCTGGAGGGTCCCTGAAACTCTCATG TGCAGCCTCTGGATTCACCTTCAATATCTACGCCATGAACTGGGTCCGCCAGGCTCCAGGAAGG GTTTGGAATGGGTTGCTCGCATAAGAAGTAAATATAATTATTACAACATATTATGCCGATTCA GTGAAAAGCAGGTTCACCATCTCCAGAGATGATTCAAAAAACACTGCCTATCTACAAATGAACAA CTTGAAAACTGAGGACACTGCCGTTACTACTGTGTGAGACATGGAACTTCGGTAATAGCTACG TATCCTTCTTCGCTTACTGGGGCCAAGGGACTCTGGTCACCGTCTCCTCA |

| SEQ ID NO. | DESIGNATION | SOURCE | TYPE | SEQUENCE |
|---|---|---|---|---|
| 17. | VL of F6A | artificial | aa | QTVVTQEPSLTVSPGGTVLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 18. | VL of F6A | artificial | nt | CAGACTGTGTGACTCAGGAACCTTCACTCACCGTATCACCTGGTGGAACAGTCACACTCACTTG TGGCTCCTCGACTGGGCTGTTACATCTGGCTACTACCCAAACTGGGTCCAAAAACCAGGTC AGGCACCCCCGTGTCTAATAGGTGGACTAAGTTCCTGGCCCCGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTTCGGTGGAGGAACCAAACTGACTGTCC TA |
| 19. | VH-P of F6A | artificial | aa | EVQLLESGGGLVQPGGSLKLSCAASGFTFNIYAMNWVRQAPGKGLEWVARIRSKYNNYATYYADS VKSRFTISRDDSKNTAYLQMNNLKTEDTAVYYCVRHGNFGNSVSFFAYWGQGTLVTVSS |
| 20. | VH-P of F6A | artificial | nt | GAGGTGCAGCTGCTCGAGTCTGGAGGAGGATTGGTGCAGCCTGGAGGGTCATTGAAACTCTCATG TGCAGCCCTCTGGATTCACCTTCAATATCTACGCCATGAACTGGGTTCCGCCAGGCTCCAGGAAAGG GTTTGGAATGGGTTGCTCGCATAAGAAGTAAATATAATTATGCAACATATTATGCCGATTCA GTGAAAGCAGGTTCACCATCTCCAGAGATGATTCAAAAAACACTGCCTATCTACAAATGAACAA CTTGAAAACTGAGGACACTGCCGTGTACTACTGTGTGAGACATGGGAACATGGGAACTTCGGTAATAGCTACG TATCCTTCTTCGCTTACTGGGGCCAAGGGACTCTGGTCACCGTCTCCTCA |
| 21. | VL-P of F6A | artificial | aa | ELVVTQEPSLTVSPGGTVLTCGSSTGAVTSGYYPNWVQQKPGQKPGQAPRGLIGGTKFLAPGTPARFS GSLLGGKAALTLSGVQPEDEAEYYCALWYSNRWVFGGGTKLTVL |
| 22. | VL-P of F6A | artificial | nt | GAGCTCGTTGTGACTCAGGAACCTTCACTCACCGTATCACCTGGTGGAACAGTCACACTCACTTG TGGCTCCTCGACTGGGCTGTTACATCTGGCTACTACCCAAACTGGGTCCAACAAAACCAGGTC AGGCACCCCCGTGTCTAATAGGTGGACTAAGTTCCTGCCCCGTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTTCGGTGGAGGAACCAAACTGACTGTCC TA |
| 23. | VH-VL of F6A | artificial | aa | EVQLVESGGGLVQPGGSLKLSCAASGFTFNIYAMNWVRQAPGKGLEWVARIRSKYNNYATYYADS VKSRFTISRDDSKNTAYLQMNNLKTEDTAVYYCVRHGNFGNSVSFFAYWGQGTLVTVSSGGGGS GGGGSGGGGSQTVVTQEPSLTVSPGGTVLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 24. | VH-VL of F6A | artificial | nt | GAGGTGCAGCTGGTCGAGTCTGGAGGAGGATTGGTGCAGCCTGGAGGGTCATTGAAACTCTCATG TGCAGCCCTCTGGATTCACCTTCAATATCTACGCCATGAACTGGGTCCGCCAGGCTCCAGGAAAGG GTTTGGAATGGGTTGCTCGCATAAGAAGTAAATATAATTATGCAACATATTATGCCGATTCA GTGAAAGCAGGTTCACCATCTCCAGAGATGATTCAAAAAACACTGCCTATCTACAAATGAACAA CTTGAAAACTGAGGACACTGCCGTGTACTACTGTGTGAGACATGGGAACATGGGAACTTCGGTAATAGCTACG TATCCTTCTTCGCTTACTGGGGCCAAGGGACTCTCGGTCACCGTCTCCTCAGGAACCTTCACCTGGT GGCGGCGGCTCCGGTGGAGGTGGATCACAGTACAGTCACCACTTGTGGCCTCCTCGACTGGGCTGTTACATCTGGCTACT ATCACCTGGTGGAACAGTCACAAAACCAGGTCAGGCACCCCCTGTCTTGGAGGCAAGGCTGCCCTCACCCT CTCGCCCCGTACAGCCAGAGGATGAGGCAGAATATTACTGTGCTCTATGGTACAGCAACCGCTGGG TGTTCGGTGGAGGAACCAAACTGACTGTCCTA |

-continued

| SEQ ID NO. | DESIGNATION | SOURCE | TYPE | SEQUENCE |
|---|---|---|---|---|
| 25. | VH-VL-P of F6A | artificial | aa | EVQLLESGGGLVQPGGSLKLSCAASGFTFNIYAMMWVRQAPGKGLEWVARIRSKYNNYATYYADS VKSRFTISRDDSKNTAYLQMNNLKTEDTAVYYCVRHGNFGNSYVSFFAYWGQGTLVTVSSGGGGS GGGSGGGGSELVTQEPSLTVSPGGTVTLTCGSSTGAVTSGYYPNWQQKPGQAPRGLIGGTKF LAPGTPARFSGSLLGGKAALTLSGVQPEDEAEYYCALWYSNRWVFGGGTKLTVL |
| 26. | VH-VL-P of F6A | artificial | nt | GAGGTGCAGCTGCTCTGAGTCTGGAGGAGGATTGGTGCAGCCTGGAGGGTCCAGCTCTCATG TGCAGCCCTCTGATTCACCTTCACATATGCGCCATGACTACGCCATGATCTCCAGGCTCCAGGAAGG GTTTGGAATGGGTTGCTCCATAAGAAGTAAATATAATTATGCAACATATTATGCCGATTCA GTGAAAAGACAGGTTCACCATCTCCAGAGATGATTCAAAAACACTGCCTATCTACAAATGAACAA CTTGAAAACTCTTCGCTTACTGGGCCAAGGACTCTGTGACTACTGTGTACTACAGTACTAGCTACG TATCCTTCTTCGCTTACTGGGCCAAGGACTCTGTGACTACTGTGTACTACCAGTTGGTGTGGTTCT GGCGGCGGCGGCTCGGTGGTGGTCACTTGGTGTTCTGAGCTGTGACTCTGGGCTGTTACATCTGGCTACT ATCACCTGGAACAGTCACACTTGGTGCCTCTGCACTCTGGGCTGTTACATCTGGCTACT ACCCAAACTGGTCCAACAAAAACCAGGCACCCCGTCTGGAATAGGTGGACTAAGTTC CTCGCCCCGTACTCCTGCCAGATTCCAGGCTTCCTTGGAGGCAAGGCTGCCTTCACCT CTCAGGGGTACAGCCAGAGGATGAGGCAGAATATTACTGTGCTCTATGGTACAACCGCCTGGG TGTTCGGTGGAGGAACCAAACTGACTGTCCTA |
| 27. | CDR-L1 of H2C | artificial | aa | GSSTGAVTSGYYPN |
| 28. | CDR-L2 of H2C | artificial | aa | GTKFLAP |
| 29. | CDR-L3 of H2C | artificial | aa | ALWYSNRWV |
| 30. | CDR-H1 of H2C | artificial | aa | KYAMN |
| 31. | CDR-H2 of H2C | artificial | aa | RIRSKYNNYATYYADSVKD |
| 32. | CDR-H3 of H2C | artificial | aa | HGNFGNSYISYWAY |
| 33. | VH of H2C | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSS |
| 34. | VH of H2C | artificial | nt | GAGGTGCAGCTGGTCGAGTCTGGAGGAGGATTGGTGCAGCCTGGAGGGTCCAGCTCTCATG TGCAGCCTCTGATTCACCTTCACATAAGTACGCCATGAACTGGGTCCGCCAGGCTCCAGGAAAGG GTTTGGAATGGGTTGCTCGCATAAGAAGTAAATATAATTATGCAACATATTATGCCGATTCA GTGAAAGACAGGTTCACCATCTCCAGAGATGATTCAAAAACACTGCCTATCTACAAATGAACAA CTTGAAAACTCGAGGACACTGGTTACTACTGTGTACGACACTTGGGACTTCGGTAATAGCTACA TATCCTACTGGGCTTACTGGGCCAAGGACTCTGGTCACCGTCTCCTCA |
| 35. | VL of H2C | artificial | aa | QTVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 36. | VL of H2C | artificial | nt | CAGACTGTTGTGACTCAGGAACCTTCACTCACCGTATCACCTGTGGAACAGTCACACTTG TGGCCTCCTGGACTGGGCTGTTAATAGGTGGACTAAGTTCCTGCCCGCTACTCCTGCCAGATTCTCA AGGCACCCCGTCTGCCTTGAGGCAAGGCTGCCCCTCACCCTCTCAGGGGTACAGCAGGATGAGGCAGA GGCTCCCTGCTTGAGGCAAGGCTGCCCCTCACCCTCTCAGGGGTACAGCAGGATGAGGCAGA ATATTACTGTGCTCTATGGTACAGCAACCGCTGGGTGTTCGGTGGAGGAACCAAACTGACTGTCC TA |
| 37. | VH-P of H2C | artificial | aa | EVQLLESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSS |

| SEQ ID NO. | DESIGNATION | SOURCE | TYPE | SEQUENCE |
|---|---|---|---|---|
| 38. | VH-P of H2C | artificial | nt | GAGGTGCAGCTGCTCGAGTCTGGAGGAGGATTGGTGCAGCCTGAGGGTCATTGAAACTCTCATG TGCAGCCTCTGGATTCACCTTCAATAAGTACGCCATGAACTGGGTCCGCCAGGCTCCAGGAAAGG GTTTGGAATGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAACTGAGGACACTGGGTCACTGTGTACTACTGTGTGAGACATGGAACTTCGGTAATAGCTACA TATCCTACTGGGCTTACTGGGCCAAGGGACTCTGGTCACCGTCTCCTCA |
| 39. | VL-P of H2C | artificial | aa | ELVVTQEPSLTVSPGGTVLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 40. | VL-P of H2C | artificial | nt | GAGCTCGTTGACTCAGGAACCTTCACTCACCGTATCACCTGGTGAACAGTCACACTCACTTG TGGCTCCTCGACTGGGGCTGTTACATCTCGGCTACTACCCAACTGGGTCCAAACTGGCCCAAAAACCAGGTC AGGCACCCCGTGCTAATAGGTGGACAAGGTTCCTCACCCTCACCCTCAGGGTACAGCCAGATTCTCA GCTTTCCCTGCTTGAGGCAAGCTGCCTTCACCCTCACCCTCAGGGTACAGCCAGAGGATGAGGCAGA ATATTACTGTCTCTATGGTACAGCAACCGTGGTGTTCGGTGGAGGAACCAAACTGACTGTCC TA |
| 41. | VH-VL of H2C | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSQTVVTQEPSLTVSPGGTVLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 42. | VH-VL of H2C | artificial | nt | GAGGTGCAGCTGCTCGAGTCTGGAGGAGGATTGGTGCAGCCTGAGGGTCCAGCCTGAGGGTCATTGAAACTCTCATG TGCAGCCTCTGGATTCACCTTCAATAAGTACGCCATGAACTGGGTCCGCCAGGCTCCAGGAAAGG GTTTGGAATGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAACTGAGGACACTGGGTCACTGTGTACTACTGTGTGAGACATGGAAACTTCGGTAATAGCTACA TATCCTACTGGGCTTACTGGGGCCAAGGGACTCTGGTCACCGTCTCCTCAGGTGGTGGTGGTTCT GGCGGCGGCGGCTCCGGTGGTGGTGGATCTCAGACTGTGTGACTCAGGAACCTTCACTCAGCT ATCACCTGGTGGAACAGTCACACTCACTTGTGGCTCCTCAGGACTGTCTAATAGGTGGACTAAGTTC ACCCAAACTGGGTCCAAACAAAACCAGGTCAGGACTCCAGGTCCCAGAATCCAGGAATCAGCCTTCAGGTCGCTGTGCTCTATGGTACAGCAACCGCTGGG TGTTCGGTGGAGGAACCAAACTGACTGTCCTA |
| 43. | VH-VL-P of H2C | artificial | aa | EVQLLESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSELVVTQEPSLTVSPGGTVLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 44. | VH-VL-P of H2C | artificial | nt | GAGGTGCAGCTGCTCGAGTCTGGAGGAGGATTGGTGCAGCCTGAGGGTCATTGAAACTCTCATG TGCAGCCTCTGGATTCACCTTCAATAAGTACGCCATGAACTGGGTCCGCCAGGCTCCAGGAAAGG GTTTGGAATGGTTGCTCGCATAAGAAGTAAATATAATAATTATGCAACATATTATGCCGATTCA GTGAAAGACAGGTTCACCATCTCCAGAGATGATTCAAAAAACACTGCCTATCTACAAATGAACAA CTTGAAACTGAGGACACTGGGTCACTGTGTACTACTGTGTGAGACATGGAAACTTCGGTAATAGCTACA TATCCTACTGGGCTTACTGGGGCCAAGGGACTCTGGTCACCGTCTCCTCAGGTGGTGGTGGTTCT GGCGGCGGCGGCTCCGGTGGTGGTGGATCTGAGCTCGTTGTGACTCAGGAACCTTCACTCAGCT ATCACCTGGTGGAACAGTCACACTCACTTGTGGCTCCTCAGGACTGTGTAATCTGGCTACT ACCCAAACTGGGTCCAAACAAAACCAGGTCAGGACACCCCGTGCTAAGGCTGGACTAAGTTC CTCGCCCCCGTACTCCTGCAGATTCTCAGGCTCCAGGCTCCTTGAGGCAAGGCTGGACTAAGTTC |

-continued

| SEQ ID NO. | DESIGNATION | SOURCE | TYPE | SEQUENCE |
|---|---|---|---|---|
| | | | | CTCAGGGGTACAGCCAGGAGGATGAGGCAGAATATTACTGTGCTTATGTACAGCAACCGCTGGG<br>TGTTCGGTGGAGGAACCAAACTGACTGTCCTA |
| 45. | CDR-L1 of H1E | artificial | aa | GSSTGAVTSGYYPN |
| 46. | CDR-L2 of H1E | artificial | aa | GTKFLAP |
| 47. | CDR-L3 of H1E | artificial | aa | ALWYSNRWV |
| 48. | CDR-H1 of H1E | artificial | aa | SYAMN |
| 49. | CDR-H2 of H1E | artificial | aa | RIRSKYNNYATYYADSVKG |
| 50. | CDR-H3 of H1E | artificial | aa | HGNFGNSYLSFWAY |
| 51. | VH of H1E | artificial | aa | EVQLVESGGGLEQPGGSLKLSCAASGFTFNSYAMNWVRQAPGKGLEWVARIRSKYNNYATYYADS<br>VKGRFTISRDDSKNTAYLQMNNLKTEDTAVYYCVRHGNFGNSYLSFWAYWGQGTLVTVSS |
| 52. | VH of H1E | artificial | nt | GAGGTGCAGCTCGGTCGAGTCTGGAGGAGGATTGGAGCAGCCTGGAGGGTCCGCCAGCTCCATG<br>TGCAGCCTCTGGATTCACCTTCAGCATAAGCTACGCCATGAACTGGGTCCGCCAGGCTCCAGGAAAGG<br>GTTTGGAATGGGTTGCTCGCATAAGAAGTAAATATAATTATGCAACATATATTATGCCGATTCA<br>GTGAAAGGGAGGTTCACCATCTCCAGAGATGATTCAAAAAACACTGCCTATCTACAAATGAACA<br>CTTGAAAACTGAGGACACTGCCGTGTACTACTGTGTGAGACATGGAAACTTCGGTAATAGCTACC<br>TATCCTTCTGGGCTTACTGGGGCCAAGGCACTCGTCACCGTCTCCTC |
| 53. | VL of H1E | artificial | aa | QTVVTQEPSLTVSPGGTVTLTCGSSTGAVTSGYYPNWVQQKPGQAPRGLIGGTKFLAPGTPARFS<br>GSLLGGKAALTLSGVQPEDEAEYYCALWYSNRWVFGGGTKLTVL |
| 54. | VL of H1E | artificial | nt | CAGACTGTTGTGACTCAGGAACCTTCACTCACCGTATCACCTGGTGGAACAGTCACACTCACTTG<br>TGGCTCCTCGACTGGGCTGTTACATCTGGCTACTACCCAAACTGGGTCCAACAAAAACCAGGTC<br>AGGCACCCCGTGTCTAATAGGTGGCAAGGTCCGCCCACCTGTACTTCCCGCCCGTACTCCTGCCAGATTCTCA<br>GGCTCCCCTGCTTGAGGGCAAGGCTGCCCTCACCCTCGGGGTGTTCGGTGAGGAACAGATGAGGCAGA<br>ATATTACTGTGCTCTATGGTACAGCAACCGCTGGGTGTTCGGTGGAGGAACCAAACTGACTGTCC<br>TA |
| 55. | VH-P of H1E | artificial | aa | EVQLLESGGGLEQPGGSLKLSCAASGFTFNSYAMNWVRQAPGKGLEWVARIRSKYNNYATYYADS<br>VKGRFTISRDDSKNTAYLQMNNLKTEDTAVYYCVRHGNFGNSYLSFWAYWGQGTLVTVSS |
| 56. | VH-P of H1E | artificial | nt | GAGGTGCAGCTGCTCGAGTCTGGAGGAGGATTGGAGCAGCCTGGAGGGTCCGCCAGCTCCATG<br>TGCAGCCTCTGGATTCACCTTCAATTCAGCATAAGCTACGCCATGAACTGGGTCCGCCAGGCTCCAGGAAAGG<br>GTTTGGAATGGGTTGCTCGCATAAGAAGTAAATATAATTATGCAACATATATTATGCCGATTCA<br>GTGAAAGGGAGGTTCACCATCTCCAGAGATGATTCAAAAAACACTGCCTATCTACAAATGAACA<br>CTTGAAAACTGAGGACACTGCCGTGTACTACTGTGTGAGACATGGAAACTTCGGTAATAGCTACC<br>TATCCTTCTGGGCTTACTGGGGCCAAGGCACTCGTCACCGTCTCCTCA |
| 57. | VL-P of H1E | artificial | aa | ELVVTQEPSLTVSPGGTVTLTCGSSTGAVTSGYYPNWVQQKPGQAPRGLIGGTKFLAPGTPARFS<br>GSLLGGKAALTLSGVQPEDEAEYYCALWYSNRWVFGGGTKLTVL |
| 58. | VL-P of H1E | artificial | nt | GAGCTCGTTGTGACTCAGGAACCTTCACTCACCGTATCACCTGGTGGAACAGTCACACTCACTTG<br>TGGCTCCTCGACTGGGCTGTTACATCTGGCTACTACCCAAACTGGGTCCAACAAAAACCAGGTC<br>AGGCACCCCGTGTCTAATAGGTGGCAAGGTCCGCCCGTACTCCTGCCAGATTCTCA |

-continued

| SEQ ID NO. | DESIGNATION | SOURCE | TYPE | SEQUENCE |
|---|---|---|---|---|
| 59. | VH-VL of H1E | artificial | | GGCTCCCTGCTTGGAGGCAAGGCTGCCCTCACCCTCTCAGGGGTACAGCCAGGAGGATGAGGCAGA<br>ATATTACTGTCTCTATGGTACAGCAACCCTGGGTGTTCGGTGGAGGAACCAAACTGACTGTCC<br>TA |
| | | | aa | EVQLVESGGGLEQPGGSLKLSCAASGFTFNSYAMNWVRQAPGKGLEWVARIRSKYNNYATYYADS<br>VKGRFTISRDDSKNTAYLQMNNLKTEDTAVYYCVRHGNFGNSYLSFWAYWGQGTLVTVSSGGGGS<br>GGGGSGGGGSQTVVTQEPSLTVSPGGTVLTCGSSTGAVTSGYYPNWVQQKPGQAPRGLIGGTKF<br>LAPGTPARFSGSLLGGKAALTLSGVQPEDEAEYYCALWYSNRWVFGGGTKLTVL |
| 60. | VH-VL of H1E | artificial | nt | GAGGTGCAGCTGGTCGAGTCTGGAGGAGGATTGGAGCAGCCTGGAGGGTCATTGAAACTTCATG<br>TGCAGCCCTCTGGATTCACCTTCAATTCGTACGCCATGAACTGGGTCCGCCAGGCTCCAGGAAAGG<br>GTTTGGAATGGGTTGCTCGCATAAGAAGTAAATATAATTATGCAACATATATGCCGATTCA<br>GTGAAAGGAGGTTCACCATCTCCAGAGATGATTCAAAAAACACTGCCTATCTACAAATGAACAA<br>CTTGAAAACTGAGGACACTGCCGTGTACTACTGTGTGAGACATGGAACTTCGGTAATAGCTACC<br>TATCCTTCTGGGCTTACTGGGGCCAAGGGACTCTGGTCACCGTCTCCTCAGGTGGTGGTTCT<br>GGCGGCGGCGGCTCCGGTGGTGGTTCTCAGACTGTGTGACTCAGGAACCTTCACTCACCGT<br>ATCACCTGTGGAACAGTCACACTTCGTGGCTCTGGTCTAATAGGTGGACTAAGTTC<br>ACCCAAACTGGGTCCAACAAAAACCAGGTCAGGGTCTCCAGGGTCTGTTACATCTGGCTACT<br>CTCGCCCCCGTACTCCTGCCAGATTCAGGCAGAGGATGAGGCAGAATATTACTGTGCTCTATGGTACAGCAACCTGCCCTCACCCT<br>CTCAGGGGTACAGCCAGGAGGATGAGGCAGAATATTACTGTGCTCTATGGTACAGCAACCGTGGG<br>TGTTCGGTGGAGGAACCAAACTGACTGTCCTA |
| 61. | VH-VL-P of H1E | artificial | aa | EVQLLESGGGLEQPGGSLKLSCAASGFTFNSYAMNWVRQAPGKGLEWVARIRSKYNNYATYYADS<br>VKGRFTISRDDSKNTAYLQMNNLKTEDTAVYYCVRHGNFGNSYLSFWAYWGQGTLVTVSSGGGGS<br>GGGGSGGGGSELVVTQEPSLTVSPGGTVLTCGSSTGAVTSGYYPNWVQQKPGQAPRGLIGGTKF<br>LAPGTPARFSGSLLGGKAALTLSGVQPEDEAEYYCALWYSNRWVFGGGTKLTVL |
| 62. | VH-VL-P of H1E | artificial | nt | GAGGTGCAGCTGCTCGAGTCTGGAGGAGGATTGGAGCAGCCTGGAGGGTCATTGAAACTTCATG<br>TGCAGCCCTCTGGATTCACCTTCAATTCGTACGCCATGAACTGGGTCCGCCAGGCTCCAGGAAAGG<br>GTTTGGAATGGGTTGCTCGCATAAGAAGTAAATATAATTATGCAACATATATGCCGATTCA<br>GTGAAAGGAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACATGGAACTTCGGTAATAGCTACC<br>TATCCTTCTGGGCTTACTGGGGCCAAGGGACTCTGGTCACCGTCTCCTCAGGTGGTGGTTCT<br>GGCGGCGGCGGCTCCGGTGGTGGTTCTGAGCTGGTTGTTGACTCAGGAACCTTCACTCACCGT<br>ATCACCTGTGGAACAGTCACACTTCGTGGCTCTGGTCTAATAGCTGCTACT<br>ACCCAAACTGGGTCCAACAAAAACCAGGTCAGGGTCTCCAGGGTCTGTTACATCTGGCTACT<br>CTCGCCCCCGTACTCCTGCCAGATTCAGGCAGAGGATGAGGCAGAATATTACTGTGCTCTATGGTACAGCAACCTGCCCTCACCCT<br>CTCAGGGGTACAGCCAGGAGGATGAGGCAGAATATTACTGTGCTCTATGGTACAGCAACCGTGGG<br>TGTTCGGTGGAGGAACCAAACTGACTGTCCTA |
| 63. | CDR-L1 of G4H | artificial | aa | GSSTGAVTSGYYPN |
| 64. | CDR-L2 of G4H | artificial | aa | GTKFLAP |
| 65. | CDR-L3 of G4H | artificial | aa | ALWYSNRWV |
| 66. | CDR-H1 of G4H | artificial | aa | RYAMN |
| 67. | CDR-H2 of G4H | artificial | aa | RIRSKYNNVATYYADSVKG |
| 68. | CDR-H3 of G4H | artificial | aa | HGNFGNSYLSYFAY |

| SEQ ID NO. | DESIGNATION | SOURCE | TYPE | SEQUENCE |
|---|---|---|---|---|
| 69. | VH of G4H | artificial | aa | EVQLVESGGGLVQPGGSLKLSCAASGFTFNRYAMNWVRQAPGKGLEWVARIRSKYNNYATYYADS VKGRFTISRDDSKNTAYLQMNNLKTEDTAVYYCVRHGNFPGNSYLSYFAYWGQGTLVTVSS |
| 70. | VH of G4H | artificial | nt | GAGGTGCAGCTGGTCGAGTCTGGAGGAGGATTGGTGCAGCCTGGAGGGTCCGCCATGAAACTCTCATG TGCAGCCTCTGGAATTCACCTTCGCATAAGAACTTACGCCATGAATAATTATGCCATGAACTGGGTCCGCCAGGCTCCAGGGAAAGG GTTTGGAATGGGTTGCTCGCATAAGAAGTAAATATAATTATGCAACATATTATGCCGATTCA GTGAAAGGAGGTTCACCATTCCAGATGATTCAAAAACACTGCCTATCTACAAATGAACA CTTGAAAACTGAGGACACTGCCGTGTACTACTGTGTGAGACATGGGAACATGGGAACTTCGGTAATAGCTACT TATCCTACTTCGCTTACTGGGGCCAAGGGACTCTGGTCACCGTCTCCTCA |
| 71. | VL of G4H | artificial | aa | QTVVTQEPSLTVSPGGTVLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 72. | VL of G4H | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGTCTAATAGGTGGGACTAAGTTCCTCGCCCCGTACTCCTGCCAGATTCTCA GGCTCCCTGCTCCTGGGAGCAAGGCTGCCCTCACCCTCAGGGGTACAGCCAGAGGATGAGGCAGA ATATTACTGTGCTCTATGGTACAGCAACCCGCTGGGTGTTCGGTGGAGGAACCAAACTGACTGTCC TA |
| 73. | VH-P of G4H | artificial | aa | EVQLLESGGGLVQPGGSLKLSCAASGFTFNRYAMNWVRQAPGKGLEWVARIRSKYNNYATYYADS VKGRFTISRDDSKNTAYLQMNNLKTEDTAVYYCVRHGNFPGNSYLSYFAYWGQGTLVTVSS |
| 74. | VH-P of G4H | artificial | nt | GAGGTGCAGCTGCTCGAGTCTGGAGGAGGATTGGTGCAGCCTGGAGGGTCCGCCATGAAACTCTCATG TGCAGCCTCTGGAATTCACCTTCGCATAAGAACTTACGCCATGAATAATTATGCCATGAACTGGGTCCGCCAGGCTCCAGGGAAAGG GTTTGGAATGGGTTGCTCGCATAAGAAGTAAATATAATTATGCAACATATTATGCCGATTCA GTGAAAGGAGGTTCACCATTCCAGATGATTCAAAAACACTGCCTATCTACAAATGAACA CTTGAAAACTGAGGACACTGCCGTGTACTACTGTGTGAGACATGGGAACTTCGGTAATAGCTACT TATCCTACTTCGCTTACTGGGGCCAAGGGACTCTGGTCACCGTCTCCTCA |
| 75. | VL-P of G4H | artificial | aa | ELVVTQEPSLTVSPGGTVLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 76. | VL-P of G4H | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGTCTAATAGGTGGGACTAAGTTCCTCGCCCCGTACTCCTGCCAGATTCTCA GGCTCCCTGCTCCTGGGAGCAAGGCTGCCCTCACCCTCAGGGGTACAGCCAGAGGATGAGGCAGA ATATTACTGTGCTCTATGGTACAGCAACCCGCTGGGTGTTCGGTGGAGGAACCAAACTGACTGTCC TA |
| 77. | VH-VL of G4H | artificial | aa | EVQLVESGGGLVQPGGSLKLSCAASGFTFNRYAMNWVRQAPGKGLEWVARIRSKYNNYATYYADS VKGRFTISRDDSKNTAYLVTQEPSLIVTCVRHGNPGNSYLSYFAYWGQGTLVTVSSGGGGS GGGGSGGGGSQTVVTQEPSLIVTSPGGTVTLCSSTGAVTSGYYPNWVQQKPGQAPRGLIGGTKF LAPGTPARFSGSLLGGKAALTLSGVQPEDEAEYYCALWYSNRWVFGGGTKLTVL |
| 78. | VH-VL of G4H | artificial | nt | GAGGTGCAGCTGGTCGAGTCTGGAGGAGGATTGGTGCAGCCTGGAGGGTCCGCCATGAAACTCTCATG TGCAGCCTCTGGAATTCACCTTCGCATAAGAACTTACGCCATGAATAATTATGCCATGAACTGGGTCCGCCAGGCTCCAGGGAAAGG GTTTGGAATGGGTTGCTCGCATAAGAAGTAAATATAATTATGCAACATATTATGCCGATTCA GTGAAAGGAGGTTCACCATTCCAGATGATTCAAAAACACTGCCTATCTACAAATGAACA CTTGAAAACTGAGGACACTGTGTACTACTGTGTGAGACATGGGAACATGGGAACTTCGGTAATAGCTACT |

| SEQ ID NO. | DESIGNATION | SOURCE | TYPE | SEQUENCE |
|---|---|---|---|---|
| | | | | TATCCTACTTCGCTTACTGGGCCAAGGACTCTGGTCACCGTCTCCTCAGGTGGTGGTTCT |
| | | | | GGCGGCGGCGGCTCCGGTGGTGGTGGTTCTCAGACTGTTGTGACTCAGGAACCTTCACCGT |
| | | | | ATCACCTGTGGAACAGTCACACTTGTGCTTCTCGACTGGGCTGTTACATCTGGCTACT |
| | | | | ACCCAAACTGGGTTCAGGACTCAGGCAACTTCAGGTCAGGTCAGGTCTAATAGGTGGGACTAAGTTC |
| | | | | CTCGCCCCGGTACTCCTGCCAGATTCTGCAGGCTCCCTGCTTGAGGCAAGGCTGCCCTCACCCT |
| | | | | CTCAGGGGTACAGCAGAGGATGAGGCAGAATATTACTGTGCTCTATGGTACAACCGCTGGG |
| | | | | TGTTCGGTGGAGGAACCAAACTGACTGTCCTA |
| 79. | VH-VL-P of G4H | artificial | aa | EVQLLESGGGLVQPGGSLKLSCAASGFTFNRYAMNWVRQAPGKGLEWVARIRSKYNNYATYYADS |
| | | | | VKGRFTISRDDSKNTAYLQMNNLKTEDTAVYYCVRHGNFGNSYLSYFAYWGQGTLVTVSSGGGGS |
| | | | | GGGGSGGGGSELVVTQEPSLTVSPGGTVTLTCGSSTGAVTSGYYPNWVQQKPGQAPRGLIGGTKF |
| | | | | LAPGTPARFSGSLLGGKAALTLSGVQPEDEAEYYCALWYSNRWVFGGGTKLTVL |
| 80. | VH-VL-P of G4H | artificial | nt | GAGGTGCAGCTGCTCGAGTCTGGAGGAGGATTGGTGCAGCCTGGAGGGTCATTGAAACTCTCATG |
| | | | | TGCAGCCTCTGGATTCACCTTCAATCGCTACGCCATGAACTGGGTCCGCCAGGCTCCAGGAAAGG |
| | | | | GTTTGGAATGGTTGCTCGCATAAGAAGTAAATAATAATTATGCAACATATATATGCCGATTCA |
| | | | | GTGAAAGGGAGGTTCACCATCTCCAGAGATGATTCAAAAAAACACTGCCTATCTACAAATGAACA |
| | | | | CTTGAAACTGAGGACACTGCCGTGTACTACTGTGTGAGACATGGAACTTCGGTAATAGCTACT |
| | | | | TATCCTACTTCGCTTACTGGGGCCAAGGACTCTGGTCACCGTCTCCTCAGGTGGTGGTTCT |
| | | | | GGCGGCGGCGGCTCCGGTGGTGGTGGTTCTGAGCTCGTGTGACTCAGGAACCTTCACTCGGCTACT |
| | | | | ACCCAAACTGGGTCCAACAAAAACCAGGTCAGGGTCCTCGGTCTAATAGGTGGGACTAAGTTC |
| | | | | CTCGCCCCCGTACTCCTGCCAGATTCTCCAGGCTCCCTGCTTGAGGCAAGGCTGCCCTCACCCT |
| | | | | CTCAGGGGTACAGCCAGAGGATGAGGCAGAATATTACTGTGCTCTATGGTACAGCAACCGCTGGG |
| | | | | TGTTCGGTGGAGGAACCAAACTGACTGTCCTA |
| 81. | CDR-L1 of A2J | artificial | aa | RSSTGAVTSGYYPN |
| 82. | CDR-L2 of A2J | artificial | aa | ATDMRPS |
| 83. | CDR-L3 of A2J | artificial | aa | ALWYSNRWV |
| 84. | CDR-H1 of A2J | artificial | aa | VYAMN |
| 85. | CDR-H2 of A2J | artificial | aa | RIRSKYNNYATYYADSVKK |
| 86. | CDR-H3 of A2J | artificial | aa | HGNFGNSYLSWWAY |
| 87. | VH of A2J | artificial | aa | EVQLVESGGGLVQPGGSLKLSCAASGFTFNVYAMNWVRQAPGKGLEWVARIRSKYNNYATYYADS |
| | | | | VKKRFTISRDDSKNTAYLQMNNLKTEDTAVYYCVRHGNFGNSYLSWWAYWGQGTLVTVSS |
| 88. | VH of A2J | artificial | nt | GAGGTGCAGCTGGTCGAGTCTGGAGGAGGATTGGTGCAGCCTGGAGGGTCATTGAAACTCTCATG |
| | | | | TGCAGCCTCTGGATTCACCTTCAATGTCTACGCCATGAACTGGGTCCGCCAGGCTCCAGGAAAGG |
| | | | | GTTTGGAATGGTTGCTCGCATAAGAAGTAAATAATAATTATGCAACATATATATGCCGATTCA |
| | | | | GTGAAAAAGAGGTTCACCATCTCCAGAGATGATTCAAAAAACACTGCCTATCTACAAATGAACAA |
| | | | | CTTGAAACTGAGGACACTGCCGTGTACTACTGTGTGAGACATGGAACATGGAACTTCGGTAATAGCTACT |
| | | | | TATCCTGGTGGTGCTACTGGGGCCAAGGACTCTGGTCACCGTCTCCTCA |
| 89. | VL of A2J | artificial | aa | QTVVTQEPSLTVSPGGTVTLTCRSSTGAVTSGYYPNWVQQKPGQAPRGLIGATDMRPSTPARFS |
| | | | | GSLLGGKAALTLSGVQPEDEAEYYCALWYSNRWVFGGGTKLTVL |

| SEQ ID NO. | DESIGNATION | SOURCE | TYPE | SEQUENCE |
|---|---|---|---|---|
| 90. | VL of A2J | artificial | nt | CAGACTGTTGTGACTCAGGAACCTTCACTCACCGTATCACCTGGTGGAACAGTCACACTCACTTG TCGCTCCTCGACTGGGCTGTTAATAGGTGCCACTGACATGGCCCTCTGTACTCCTGCCAGATTCTCA AGGCACCCGTGCTCTTGGAGGCAAGGCTGCCCTCACCCTGGGTTCGGGGTACAGCAGGATGAGGCAGA GGCTCCTGCTCTATGTGACAGCACCGCTGGGTGTTCGGTGTTCGGTGGAGGAACCAAACTGACTGTCC ATATTACTGTCCTATGTGACAGCACCGCTGGGTGTTCGGTGTTCGGTGGAGGAACCAAACTGACTGTCC TA |
| 91. | VH-P of A2J | artificial | aa | EVQLLESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYLSWAYWGQGTLVTVSS |
| 92. | VH-P of A2J | artificial | nt | GAGGTGCAGCTGCTCGAGTCTGGAGGAGGATTGGTGCAGCCTGGAGGGTCATTGAAACTTCATG TGCAGCCTCTGGATTCACCTTCGCATAAGAAGTAAATATAATTATTCAACATATTATGCGATTCA GTTTGGAATGGGTTGCTCGCATAAGAAGTAAATATAATTATTCAACATATTATGCGATTCA GTGAAAAGAGGTTCACCATCTCCAGAGATGAATTCAAAAAAACACTGCCTATCTACAAATGAACAA CTTGAAAACTGAGAGACACTGCCGTGTACTCTGTGAAAAGATGGGAACATTCGGTAATAGCTACT TATCCTGGTGGGCTTACTGGGGCCAAGGGACTCTGGTCACCGTCTCCA |
| 93. | VL-P of A2J | artificial | aa | ELVVTQEPSLTVSPGGTVTLTCRSSTGAVTSGYYPNWVQQKPGQAPRGLIGATDMRPSGTPARFS GSLLGGKAALTLSGVQPEDEAEYYCALWYSNRWVFGGGTKLTVL |
| 94. | VL-P of A2J | artificial | nt | GAGCTCGTTGTGACTCAGGAACCTTCACTCACCGTATCACCTGGTGGAACAGTCACACTCACTTG TCGCTCCTCGACTGGGCTGTTAATAGGTGCCACTGACATGGCCCTCTGTACTCCTGCCAGATTCTCA AGGCACCCGTGCTCTTGGAGGCAAGGCTGCCCTCACCCTGGGTTCGGGGTACAGCAGGATGAGGCAGA GGCTCCTGCTCTATGTGACAGCACCGCTGGGTGTTCGGTGGAGGAACCAAACTGACTGTCC ATATTACTGTGCTCTATGTGACAGCACCGCTGGGTGTTCGGTGGAGGAACCAAACTGACTGTCC TA |
| 95. | VH-VL of A2J | artificial | aa | EVQLVESGGGLVQPGGSLRLSCAASGFTFNVYAMNWVRQAPGKGLEWVARIRSKYNNYATYYADS VKKRFTISRDDSKNTAYLQMNNLKTEDTAVYYCVRHGNFGNSYLSWAYWGQGTLVTVSSGGGGS GGGGSGGGGSQTVVTQEPSLTVLTCRSSTGAVTSGYYPNWVQQKPGQAPRGLIGATDM RPSGTPARFSGSLLGGKAALTLSGVQPEDEAEYYCALWYSNRWVFGGGTKLTVL |
| 96. | VH-VL of A2J | artificial | nt | GAGGTGCAGCTGGTCGAGTCTGGAGGAGGATTGGTGCAGCCTGGAGGGTCATTGAAACTTCATG TGCAGCCTCTGGATTCACCTTCAATGTCTACGCCATGAACTGGGTCCGCCAGGCTCCAGGAAAGG GTTTGGAATGGGTTGCTCGCATAAGAAGTAAATATAATTATTACAACATATTATGCCGATTCA GTGAAAAGAGGTTCACCATCTCCAGAGATGATTCAAAAAAACACTGCCTATCTACAAATGAACAA CTTGAAAACTGAGGACACTGCCGTGTACTACTGTGTGAGACATGGAACTTCGGTAATAGCTACT TATCCTGGTGGGCTTACTGGGGCCAAGGGACACTCTGGTCACCGTCTCCAGTGTGGTGTTCT GGCGGCGGCGGCAGTGGCGGTGGTTCTCAGACTGTGTGACTCAGGAACCTTCACTCACCGT ATCACCTGTCGAACAGTCACACTTGCTCCTCGCTCAGGGCTCTAATAGGTGCCACTGACATG ACCCAAACTGGGTCCAACAAAAACCAGGTCAGGCACCCGTGCTCCTTGGCTCATTGAGCAAGG AGGCCCTCTGGTACTCCTGCCAGATTCTCAGGCTTCCAGGCTCCAGGCTACCGCCTCACCCT CTCAGGGTACAGCCAGAGGATGAGGCAGAGAATATTACTGTCCTTATGTGACACCGCTGGG TGTTCGGTGGAGGAACCAAACTGACTGTCCTA |
| 97. | VH-VL-P of A2J | artificial | aa | EVQLLESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYLSWAYWGQGTLVTVSSGGGGS GGGGSGGGGSELVVTQEPSLTVSPGGTVTLTCRSSTGAVTSGYYPNWVQQKPGQAPRGLIGATDM RPSGTPARFSGSLLGGKAALTLSGVQPEDEAEYYCALWYSNRWVFGGGTKLTVL |

-continued

| SEQ ID NO. | DESIGNATION | SOURCE | TYPE | SEQUENCE |
|---|---|---|---|---|
| 98. | VH-VL-P of A2J | artificial | nt | GAGGTGCAGCTGCTCGAGTCTGGAGGAGGATTGGTGCAGCCTGGAGGGTCATTGAAACTCTCATG<br>TGCAGCCCTCTGGATTCACCTTCAATGTCTACGCCATGAACTGGGTCCGCCAGGCTCCAGGAAAGG<br>GTTTGGAATGGGTTGCTCGCATAAGAAGTAAATATAATTATGCAACATATTATGCCGATTCA<br>GTGAAAAGAGGTTCACCATCTCCAGAGATGATTCAAAAACACTGCCTATCTACAAATGAACAA<br>CTTGAAACTGAGGACACTGCCGTGTACTACTGTGTGAGACATGGAACATGGACTTCGTAATAGCTACT<br>TATCCTGGTGGGCGCTACTGGGGCCAAGGGACTCTGGTCACCGTCTCCTCAGGTGGTGGTTCT<br>GGCGGCGGCGGCTCCGGTGGTGGTTCTGAGCTCGTTGTGACTCAGGGACTGTTACATCTGGCTACT<br>ATCACCTGGTGGAACAGTCACACTTGTCTGCCTCCAGGGGTCTAATAGGTGCCAATGCACATG<br>ACCCAAACTGGGTCCAACAAAAACCAGGTGAGATTCCTGGCCTGGTCTAATAGGTGCCAATGACATG<br>AGGCCCTCTGACTACTCCGCAGAGGATGAGGCAGAATTACTGTGCTCTATGGTACAGCAACCGTGGG<br>TGTTCGGTGGAGGAACCAAACTGACTGTCCTA |
| 99. | CDR-L1 of E1L | artificial | aa | GSSTGAVTSGYYPN |
| 100. | CDR-L2 of E1L | artificial | aa | GTKFLAP |
| 101. | CDR-L3 of E1L | artificial | aa | ALWYSNRWV |
| 102. | CDR-H1 of E1L | artificial | aa | KYAMN |
| 103. | CDR-H2 of E1L | artificial | aa | RIRSKYNNYATYYADSVKS |
| 104. | CDR-H3 of E1L | artificial | aa | HGNFGNSYTSYYAY |
| 105. | VH of E1L | artificial | aa | EVQLVESGGGLVQPGGSLKLSCAASGFTFNKYAMNWVRQAPGKGLEWVARIRSKYNNYATYYADS<br>VKSRFTISRDDSKNTAYLQMNNLKTEDTAVYYCVRHGNFGNSYTSYYAYWGQGTLVTVSS |
| 106. | VH of E1L | artificial | nt | GAGGTGCAGCTGTTGGAGTCTGGAGGAGGATTGGTGCAGCCTGGAGGGTCATTGAAACTCTCATG<br>TGCAGCCCTCTGGATTCACCTTCAATAAGTACGCCATGAACTGGGTCCGCCAGGCTCCAGGAAAGG<br>GTTTGGAATGGGTTGCTCGCATAAGTCCAAGTATAATTATGCAACATATTATGCCGATTCA<br>GTGAAATCGAGGTTCACCATCTCCAGAGATGATTCAAAAAACACTGCCTATCTACAAATGAACAA<br>CTTGAAACTGAGGACACTGCCGTGTACTACTGTGTGAGACATGGAACATGGACTTCGTAATAGCTACA<br>CATCCTACTGGGGCCAAGGGACTCTGGTCACCGTCTCCTCA |
| 107. | VL of E1L | artificial | aa | QTVVTQEPSLTVSPGGTVTLTCGSSTGAVTSGYYPNWVQQKPGQAPRGLIGGTKFLAPGTPARFS<br>GSLLGGKAALTLSGVQPEDEAEYYCALWYSNRWVFGGGTKLTVL |
| 108. | VL of E1L | artificial | nt | CAGACTGTTGTGACTCAGGAACCTTCACTCACCGTATCACCTGGTGGAACAGTCACACTTGG<br>TGGCTCCTCCAGACTGGGGTCTAATAGGTGGACTAAGTTCCTGCCCCCGTACTCCTGCCAGATTCTCA<br>AGGACACCCGTGCTTGAGGCAAGGCTGCCCTCACCGTCAGGGGTACAGCCAGAGGATGAGGCAGA<br>ATATTACTGTGCTCTATGGTACAGCAACCGCTGGGTGTTCGGTGGAGGAACCAAACTGACTGTCC<br>TA |
| 109. | VH-P of E1L | artificial | aa | EVQLLESGGGLVQPGGSLKLSCAASGFTFNKYAMNWVRQAPGKGLEWVARIRSKYNNYATYYADS<br>VKSRFTISRDDSKNTAYLQMNNLKTEDTAVYYCVRHGNFGNSYTSYYAYWGQGTLVTVSS |
| 110. | VH-P of E1L | artificial | nt | GAGGTGCAGCTGCTCGAGTCTGGAGGAGGATTGGTGCAGCCTGGAGGGTCATTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAATATAATTATGCAACATATTATGCCGATTCA |

| SEQ ID NO. | DESIGNATION | SOURCE | TYPE | SEQUENCE |
|---|---|---|---|---|
| 111. | VL-P of E1L | artificial | | GTGAAATGAGGTTCACCATCTCCAGAGATGATTCAAAAAACACTGCCTATCTACAAATGAACAA CTTGAAAACTGAGGACACTGCCGTCTACTACTGTGTGAGACATGGGAACATTCGGTAATAGCTACA CATCCTACTACGCTTACTGGGGCCAAGGCTCGGTGACTGTCCTCGTCTCCTCA |
| 112. | VL-P of E1L | artificial | aa | ELVVTQEPSLTVSPGGTVLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 113. | VH-VL of E1L | artificial | nt | GAGGTCGTTGTGACTCAGGAACCTTCACTCACCGTATCACCTGGTGGAACAGTCACACTCACTTG TGGCTCCTCGACTGGCGTGTTACATCTGGCTACTACCCAAACTGGGTCCAAAACCAGGTC AGGCACCCCGGTCTAATAGGTGGACAAGGCTGCCCTCACCCTCACCCTGGGTACAGCCAGGATGAGGCAGA GGCTCCCCTGCTTGAGGCAAGGCTGCCCTCACCCTCACCCTGGGTGTTCGGTGGAGGAACCAACCTGACTGTCC ATATTACTGCTCTATGGTACAGCAACCCTGGTCTTCGGTGGAGGAACCAAACTGACTGTCC TA |
| 114. | VH-VL of E1L | artificial | aa | EVQLVESGGGLVQPGGSLKLSCAASGFTFNKYAMNWVRQAPGKGLEWVARIRSKYNNYATYYADS VKSRFTISRDDSKNTAYLQMNNLKTEDTAVYYCVRHGNFGNSYTSYYAYWGQGTLVTVSSGGGGS GGGGSGGGGSQTVVTQEPSLTVSPGGTVLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 115. | VH-VL of E1L | artificial | nt | GAGGTGCAGCTGGTCGAGTCTGGAGGAGGATTGGTGCAGCCTGGAGGGTCCAGCCTCAGGAAATGAACTTCATG TGCAGCCCTCTGGATTCACCTTCAATAAGTACGCCATGAACTGGGTCCGCCAGGCTCCAGGGAAAGG GTTTGGAATGGGTTGCTCGCATAAGAAGTAAATATAATATTACAACATATTATGCCGATTCA GTGAAATCGAGGTTCCAGACACTGCCTATCTACAAATGAACAA CTTGAAAACTGAGGACACTGCCGTGTACTACTGTGTGAGACATGGGAACTTCGGTAATAGCTACA CATCCTACTACGCTTACTGGGGCCAAGGAACCCTGGTCACCGT GGCGGCGGCGGCTCCGGTGGTGGTGGTTCTCAGACTGTGTGACTCAGGAACCTTCACTCACCGT ATCATCCTACTACGCTTACTGGGGCCAAGGAACCCTGGTCACCGT ACCCAAACTGGGTCCAACAAAAACCAGGTCAGGCACCCCCGTGCTCCTGCTTGAGGCAAGGCTGCCCTCACCCT CTCAGGCCCCGGTCTACTCCTGCCAGATTCTCAGGTCTCCTGCTTGAGGCAAGGCTGCCCTCACCCT CTCAGGCTCAGCCAGGATGAGGCAGAATATTACTGTGCTCTATGGTACAGCAACCGCTGGG TGTTCGGTGGAGGAACCAAACTGACTGTCCTA |
| 116. | VH-VL-P of E1L | artificial | aa | EVQLLESGGGLVQPGGSLKLSCAASGFTFNKYAMNWVRQAPGKGLEWVARIRSKYNNYATYYADS VKSRFTISRDDSKNTAYLQMNNLKTEDTAVYYCVRHGNFGNSYTSYYAYWGQGTLVTVSSGGGGS GGGGSGGGGSELVVTQEPSLTVSPGGTVLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 116. | VH-VL-P of E1L | artificial | nt | GAGGTGCAGCTGCTCGAGTCTGGAGGAGGATTGGTGCAGCCTGGAGGGTCCAGCCTCAGGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATATTATGCCGATTCA GTGAAATCGAGGTTCCAGACACTGCCTATCTACAAATGAACAA CTTGAAAACTGAGGACACTGCCGTGTACTACTGTGTGAGACATGGGAACTTCGGTAATAGCTACA CATCCTACTACGCTTACTGGGGCCAAGGAACCCTGGTCACCGT GGCGGCGGCGGCTCCGGTGGTGGTGGTTCTGAGCTCGTTGTGACTCAGGAACCTTCACTCACCGT ATCACCTGTGGAACAGTCACACTCACTTGTGGCTCCTCGACTGGGGTCTTACATCTGGCTACTACT CTCCAAACTGGGTCCAACAAAAACCAGGTCAGGCACCCCCGTGCTCCTGCTTGAGGCAAGGCTGCCCTCACCCT CTCGCCCCGGTCTACTCCTGCCAGATTCTCAGGTCTCCTGCTTGAGGCAAGGCTGCCCTCACCCT CTCAGGGTACAGCCAGGATGAGGCAGAATATTACTGTGCTCTATGGTACAGCAACCGCTGGG TGTTCGGTGGAGGAACCAAACTGACTGTCCTA |

| SEQ ID NO. | DESIGNATION | SOURCE | TYPE | SEQUENCE |
|---|---|---|---|---|
| 117. | CDR-L1 of E2M | artificial | aa | RSSTGAVTSGYYPN |
| 118. | CDR-L2 of E2M | artificial | aa | ATDMRPS |
| 119. | CDR-L3 of E2M | artificial | aa | ALWYSNRWV |
| 120. | CDR-H1 of E2M | artificial | aa | GYAMN |
| 121. | CDR-H2 of E2M | artificial | aa | RIRSKYNNYATYYADSVKE |
| 122. | CDR-H3 of E2M | artificial | aa | HRNFGNSYLSWFAY |
| 123. | VH of E2M | artificial | aa | EVQLVESGGGLVQPGGSLKLSCAASGFTFNGYAMNWVRQAPGKGLEWVARIRSKYNNYATYYADS VKERFTISRDDSKNTAYLQMNNLKTEDTAVYYCVRHRNFGNSYLSWFAYWGQGTLVTVSS |
| 124. | VH of E2M | artificial | nt | GAGGTGCAGCTCGAGTCTGGAGGAGGATTGGTGCAGCCTGGAGGGTCCAGCCTCATTGAAACTCTCATG TGCAGCCCTCTGGATTCACCTTCAATGGCTACGCCATGAACTGGGTTCGCCAGGCTCCAGGAAAGG GTTTGGAATGGGTTGCTCGCATAAGAAGTAAATATAATAATTATGCCGATTCA GTGAAAGAGAGGTTCACCATCTCCAGATGATTCAAAAAACACTGCCTATCTACAAATGAACAA CTTGAAAACTGAGGACACTGCCGTGTACTACTGTGTGAGACATAGGAACTTCGGTAATAGCTACT TATCCTGGTTCGCTTACTGGGGCCAAGGGACTCTGGTCACCGTCTCCTCA |
| 125. | VL of E2M | artificial | aa | QTVVTQEPSLTVSPGGTVTLTCRSSTGAVTSGYYPNWVQQKPGQAPRGLIGATDMRPSGTPARFS GSLLGGKAALTLSGVQPEDEAEYYCALWYSNRWVFGGGTKLTVL |
| 126. | VL of E2M | artificial | nt | CAGACTGTTGTGACTCAGGAACCTTCACTCACCGTGTCGGAACAGTGCACCTCACTTG TCGCTCCTCGACTGGGGTCTAATAGGTGCCACTGACATGGCCCTCTGTACTCCTGCCAGATTCTCA AGGACACCCGCTGCTTCCCTGCTTAAGGCAAGGCTGCCCCTCACCGTCACCACGCTGGGTTCAGCAGATGAGGCAGA GGCTCCCTGGTTCGCTTATGGTACAGCAACCGTGGGTGTTCGGTGGAGGAACCAAACTGACTGTCC TA |
| 127. | VH-P of E2M | artificial | aa | EVQLLESGGGLVQPGGSLKLSCAASGFTFNGYAMNWVRQAPGKGLEWVARIRSKYNNYATYYADS VKERFTISRDDSKNTAYLQMNNLKTEDTAVYYCVRHRNFGNSYLSWFAYWGQGTLVTVSS |
| 128. | VH-P of E2M | artificial | nt | GAGGTGCAGCTCCTCGAGTCTGGAGGAGGATTGGTGCAGCCTGGAGGGTCCAGCCTCATTGAAACTCTCATG TGCAGCCCTCTGGATTCACCTTCAATGGCTACGCCATGAACTGGGTTCGCCAGGCTCCAGGAAAGG GTTTGGAATGGGTTGCTCGCATAAGAAGTAAATATAATAATTATGCAACATATTATGCCGATTCA GTGAAAGAGAGGTTCACCATCTCCAGATGATGATTCAAAAAACACTGCCTATCTACAAATGAACAA CTTGAAAACTGAGGACACTGCCGTGTACTACTGTGTGAGACATAGGAACTTCGGTAATAGCTACT TATCCTGGTTCGCTTACTGGGGCCAAGGGACTCTGGTCACCGTCTCCTCA |
| 129. | VL-P of E2M | artificial | aa | ELVVTQEPSLTVSPGGTVTLTCRSSTGAVTSGYYPNWVQQKPGQAPRGLIGATDMRPSGTPARFS GSLLGGKAALTLSGVQPEDEAEYYCALWYSNRWVFGGGTKLTVL |
| 130. | VL-P of E2M | artificial | nt | GAGCTCGTTGTGACTCAGGAACTCCACTCACTTGTGGAACAGTCACACTCACTTG TCGCTCCTCGACTGGGGTCTAATAGGTGCCACTGACATGGCCCTCTGTACTCCTGCCAGATTCTCA AGGACACCCGCTGCTCCCTGCTTAAGGCAAGGCTGCCCCTCGGGGTACAGCCAGAAGAGAGGCAGA GGCTCCCTGGTTCGCTTATGGTACAGCAACCGTGGGTGTTCGGTGGAGGAACCAAACTGACTGTCC TA |

-continued

| SEQ ID NO. | DESIGNATION | SOURCE | TYPE | SEQUENCE |
|---|---|---|---|---|
| 131. | VH-VL of E2M | artificial | aa | EVQLVESGGGLVQPGGSLKLSCAASGFTFNGYAMNWVRQAPGKGLEWVARIRSKYNNYATYYADS VKERFTISRDDSKNTAYLQMNNLKTEDTAVYYCVRHRNFGNSYLSWFAYWGQGTLVTVSGGGGS GGGGSGGGGSQTVVTQEPSLTVSPGGTVTLTCRSSTGAVTSGYYPNWVQQKPGQAPRGLIGATDM RPSGTPARFSGSLLGGKAALTLSGVQPEDEAEYYCALWYSNRWVFGGGTKLTVL |
| 132. | VH-VL of E2M | artificial | nt | GAGGTGCAGCTGGTCTGAGTCTGGAGGAGGATTGGTGCAGCCTGGAGGGTCCATTGAAACTCTCATG TGCAGCCTCTGGATTCACCTTCAATGGCTACGCCATGAACTGGGTCCGCCAGGCTCCAGGAAAGG GTTTGGAATGGGTTGCTCGCATAAGAAGTAAATATAATTATGCAACATATTATGCCGATTCA GTGAAAGAGAGATTCACCATCTCCAGAGATGATTCAAAAAACACTGCTATCTACAAATGAACAA CTTGAAAACTGAAGACACTGCCGTGTACTACTGTGTGAGACATAGGAACTTCGGTAATAGCTACT TATCCTGGTTCGCTTACTGGGGCCAAGGGACTCTGGTCACCGTCTCCTCAGGTGGTGGTGGTTCT GGCGGCGGCGGCTCCGGTGGTGGTGGTTCTCAGACTGTTGTGACTCAGGAACCTTCACTGTACT ATCACCTGGTGGACAGTCAAAAACCAGTTCAGGCACCTGTTGACTGGGGCTGTTACATCTGGCTACT ACCCAAACTGGGTCCAACAAAAACCAGGTCAGGCACCCCCTGTTGACTGGGGCTGTTAATAGGTGCCACTGACATG AGGCCCTCTGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCCAACCGTGGG TGTTCGGTGGAGGAACCAAACTGACTGTCCTA |
| 133. | VH-VL-P of E2M | artificial | aa | EVQLLESGGGLVQPGGSLKLSCAASGFTFNGYAMNWVRQAPGKGLEWVARIRSKYNNYATYYADS VKERFTISRDDSKNTAYLQMNNLKTEDTAVYYCVRHRNFGNSYLSWFAYWGQGTLVTVSSGGGGS GGGGSGGGGSELVVTQEPSLTVSPGGTVTLTCRSSTGAVTSGYYPNWVQQKPGQAPRGLIGATDM RPSGTPARFSGSLLGGKAALTLSGVQPEDEAEYYCALWYSNRWVFGGGTKLTVL |
| 134. | VH-VL-P of E2M | artificial | nt | GAGGTGCAGCTGCTCTGAGTCTGGAGGAGGATTGGTGCAGCCTGGAGGGTCCATTGAAACTCTCATG TGCAGCCTCTGGATTCACCTTCAATGGCTACGCCATGAACTGGGTCCGCCAGGCTCCAGGAAAGG GTTTGGAATGGGTTGCTCGCATAAGAAGTAAATATAATTATGCAACATATTATGCCGATTCA GTGAAAGAGAGGTTCACCATCTCCAGAGATGATTCAAAAAACACTGCTATCTACAAATGAACAA CTTGAAAACTGAAGACACTGCCGTGTACTACTGTGTGAGACATAGGAACTTCGGTAATAGCTACT TATCCTGGTTCGCTTACTGGGGCCAAGGGACTCTGGTCACCGTCTCCTCAGGTGGTGGTGGTTCT GGCGGCGGCGGCTCCGGTGGTGGTGGTTCTGAGCTCGTTGTGACTCAGGAACCTTCACTCACCGT ATCACCTGGTGGACAGTCAAACACTTGTCGCTCACTTGTGACTCGGGCTGTTACATCTGGCTACT ACCCAAACTGGGTCCAACAAAAACCAGGTCAGGCACCCCCTGTTGACTGGGGCTGTTAATAGGTGCCACTGACATG AGGCCCTCTGGTACTCCTGCCAGATTCTCAGGCTCCCTGCTTGGAGGCAAGGCTGCCCTCACCCT CTCAGGGGTACAGCCAGAGGATGAGGCAGAATATTACTGTGCTCTATGGTACAGCCAACCGTGGG TGTTCGGTGGAGGAACCAAACTGACTGTCCTA |
| 135. | CDR-L1 of F70 | artificial | aa | GSSTGAVTSGYYPN |
| 136. | CDR-L2 of F70 | artificial | aa | GTKFLAP |
| 137. | CDR-L3 of F70 | artificial | aa | ALWYSNRWV |
| 138. | CDR-H1 of F70 | artificial | aa | VYAMN |
| 139. | CDR-H2 of F70 | artificial | aa | RIRSKYNNYATYYADSVKK |
| 140. | CDR-H3 of F70 | artificial | aa | HGNFGNSYISWWAY |
| 141. | VH of F70 | artificial | aa | EVQLVESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSS |

| SEQ ID NO. | DESIGNATION | SOURCE | TYPE | SEQUENCE |
|---|---|---|---|---|
| 142. | VH of F70 | artificial | nt | GAGGTGCAGCTGGTCGAGTCTGGAGGAGGATTGGTGCAGCCTGAGGGTCATTGAAACTCTCATG TGCAGCCTCTGGATTCACCTTCAATGTGTACGCCATGAATTGGGTCCGCCAGGCTCCAGGAAAGG GTTTGGAATGGGTTGCTCGCATAAGAAGTAAATATAATAAATCAACATATTATGCCGATTCA GTGAAAAAGAGGTTCACCATCTCCAGAGATGATTCAAAAAACACTGCCTATCTACAAATGAACA CTTGAAACTGAGGACACTGCCGTGTACTACTGTGTGAGACATGGAACTTCGGTAATAGCTACA TATCCTGGTGGCTTACTGGGGACTCAGGGACTCTGGTCACCGTCTCCTCA |
| 143. | VL of F70 | artificial | aa | QTVVTQEPSLTVSPGGTVLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 144. | VL of F70 | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGAGACTAAGTTCCTGCCCACCGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGAACCAAACTGACTGTCC TA |
| 145. | VH-P of F70 | artificial | aa | EVQLLESGGGLVQPGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSS |
| 146. | VH-P of F70 | artificial | nt | GAGGTGCAGCTGCTCGAGTCTGGAGGAGGATTGGTGCAGCCTGAGGGTCATTGAAACTCTCATG TGCAGCCTCTGGATTCACCTTCAATGTACGCCATGAATTGGGTCCGCCAGGCTCCAGGAAAGG GTTTGGAATGGGTTGCTCGCATAAGAAGTAAATATAATAAATCAACATATTATGCCGATTCA GTGAAAAAGAGGTTCACCATCTCCAGAGATGATTCAAAAAACACTGCCTATCTACAAATGAACA CTTGAAACTGAGGACACTGCCGTGTACTACTGTGTGAGACATGGGAACTTCGGTAATAGCTACA TATCCTGGTGGCTTACTGGGGACTCAGGGACTCTGGTCACCGTCTCCTCA |
| 147. | VL-P of F70 | artificial | aa | ELVVTQEPSLTVSPGGTVTLTCGSSTGAVTSGYYPNWVQQKPGQAPRGLIGGTKFLAPGTPARFS GSLLGGKAALTLSGVQPEDEAEYYCALWYSNRWVFGGGTKLTVL |
| 148. | VL-P of F70 | artificial | nt | GAGCTCGTTGTGACTCAGGAACCTTCACTCACCGTATCACCTGGTGGAACAGTCACACTCACTTG TGGCTCCTCGACTGGGGCTGTTACATCTGGCTACTACCCAAACTGGGTCCAACAAAAACCAGGTC AGGCACCCCGTGGTCTAATAGGTGGGACTAAGTTCCTGCCCACCGGCTACTCCTGCCAGATTCTCA GGCTCCCTGCTTGGAGGCAAGGCTGCCCTCACCCTCTCAGGGGTACAGCCAGAGGATGAGGCAGA ATATTACTGTGCTCTATGGTACAGCAACCGCTGGGTGTTCGGTGGAGAACCAAACTGACTGTCC TA |
| 149. | VH-VL of F70 | artificial | aa | EVQLVESGGGLVQPGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSSGGGGS GGGGSGGGGSQTVVTQEPSLTVPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
| 150. | VH-VL of F70 | artificial | nt | GAGGTGCAGCTGGTCGAGTCTGGAGGAGGATTGGTGCAGCCTGAGGGTCATTGAAACTCTCATG TGCAGCCTCTGGATTCACCTTCAATGTGTACGCCATGAATTGGGTCCGCCAGGCTCCAGGAAAGG GTTTGGAATGGGTTGCTCGCATAAGAAGTAAATATAATAAATCAACATATTATGCCGATTCA GTGAAAAAGAGGTTCACCATCTCCAGAGATGATTCAAAAAACACTGCCTATCTACAAATGAACA CTTGAAACTGAGGACACTGCCGTGTACTACTGTGTGAGACATGGGAACTTCGGTAATAGCTACA TATCCTGGTGGCTTACTGGGGACTCAGGGACTCTCCTCAGGTGGTGTGGTTCT GGCGGCGGCGGCTCCGGTGGTGGTTCTCAGACTGTTGTGACTCAGGAACCTTCACTCACCGT ATCACCTGGTGAACAGTCACACTCACTTGTGGCTCCTCGACTGGGCTGTTACATCTGGCTACT |

-continued

| SEQ ID NO. | DESIGNATION | SOURCE | TYPE | SEQUENCE |
|---|---|---|---|---|
| 151. | VH-VL-P of F70 | artificial | aa | ACCCAAACTGGTCCAACAAAAACCAGGTCAGGCACCCGTGGTCTAATAGGTGGACTAAGTTC CTCGCCCCCGTACTCCTGCCAGATTCCTCAGGCTGCCTTGAGGCAAGGCTGCCCTCACCCT CTCAGGGGTACAGCCAGAGGATGAGGCAGAATATTACTGTCTTATGTACAGCAACCGTGGG TGTTCGGTGAGGAACCAAACTGACTGTCCTA |
| 152. | VH-VL-P of F70 | artificial | aa | EVQLLESGGGLVQPGGSLKLSCAASGFTFNVYAMNWVRQAPGKGLEWVARIRSKYNNYATYYADS VKKRFTISRDDSKNTAYLQMNNLKTEDTAVYYCVRHGNFGNSYISWWAYWGQGTLVTVSSGGGGS GGGGSGGGGSELVVTQEPSLTVSPGGTVTLTCGSSTGAVTSGYYPNWVQQKPGQAPRGLIGGTKF LAPGTPARFSGSLLGGKAALTLSGVQPEDEAEYYCALWYSNRWVFGGGTKLTVL |
|  |  | artificial | nt | GAGGTGCAGCTGCTCGAGTCTGGAGGAGGATTGGTGCAGCCTGGAGGGTCATTGAAACTCTCATG TGCAGCCTCTGGATTCACCTTCAATGTGTACGCCATGAACTGGGTCCGCCAGGCTCCAGGAAAGG GTTTGGAATGGGTTGCTCGCATAAGAAGTAAATATAATTATTACAACATATTATGCCGATTCA GTGAAAAGAGGTTCACCATCTCCAGAGATGATTCAAAAAACACTGCCTATCTACAAATGAACAA CTTGAAAACTGAGGACACTGCCGTGTACTACTGTGTGAGGACATGGGAACTTCGGTAATAGCTACA TATCCTGGTGGGCTTACTGGGGCCAAGGGACTCTGGTTCACCGTCTCGAGGTGGTGGTGTCT GCCGGCGGCGGCTCCGGTGGTGGTGGATCTGAGCTCGTTGTGACTCAGGAACCTTCACTCACCGT ATCACCTGGTGGAACAGTCACACAGTCAGGCATACGGGGTCTAATAGGTGGACTAAGTTC ACCCAAACTGGTCCGTACTCCTGCCAGATTCCTCAGGCTGCCTTGAGGCAAGGCTGCCCTCACCCT CTCAGGGGTACAGCCAGAGGATGAGGCAGAATATTACTGTCTTATGTACAGCAACCGTGGG TGTTCGGTGAGGAACCAAACTGACTGTCCTA |
| 153. | CDR-L1 of F12Q | artificial | aa | GSSTGAVTSGNYPN |
| 154. | CDR-L2 of F12Q | artificial | aa | GTKFLAP |
| 155. | CDR-L3 of F12Q | artificial | aa | VLWYSNRWV |
| 156. | CDR-H1 of F12Q | artificial | aa | SYAMN |
| 157. | CDR-H2 of F12Q | artificial | aa | RIRSKYNNYATYYADSVKG |
| 158. | CDR-H3 of F12Q | artificial | aa | HGNFGNSYVSWWAY |
| 159. | VH of F12Q | artificial | aa | EVQLVESGGGLVQPGGSLKLSCAASGFTFNSYAMNWVRQAPGKGLEWVARIRSKYNNYATYYADS VKGRFTISRDDSKNTAYLQMNNLKTEDTAVYYCVRHGNFGNSYVSWWAYWGQGTLVTVSS |
| 160. | VH of F12Q | artificial | nt | GAGGTGCAGCTGGTCGAGTCTGGAGGAGGATTGGTGCAGCCTGGAGGGTCATTGAAACTCTCATG TGCAGCCCTCTGGATTCACCTTCAATAGCTACGCCATGAACTGGGTCCGCCAGGCTCCAGGAAAGG GTTTGGAATGGGTTGCTCGCATAAGAAGTAAATATAATTATTACAACATATTATGCCGATTCA GTGAAAGGCAGGTTCACCATCTCCAGAGATGATTCAAAAAACACTGCCTATCTACAAATGAACAA CTTGAAAACTGAGGACACTGCCGTGTACTACTGTGTGAGGACATGGGAACTTCGGTAATAGCTACG TTTCCTGGTGGGCTTACTGGGGCCAAGGGACTCTGGTTCACCGTCTCCTCA |
| 161. | VL of F12Q | artificial | aa | QTVVTQEPSLTVSPGGTVTLTCGSSTGAVTSGNYPNWVQQKPGQAPRGLIGGTKFLAPGTPARFS GSLLGGKAALTLSGVQPEDEAEYYCVLWYSNRWVFGGGTKLTVL |
| 162. | VL of F12Q | artificial | nt | CAGACTGTTGTGACTCAGGAACCTTCACTCACCGTATCACCTGGTGGAACAGTCACACTCACTTG TGGCTCCTCGACTGGGGCTGTTACATCTGGCAACTACCCAAACTGGGTCCAACAAAAACCAGGTC AGGCACCCCGGTCTAATAGGTGGGACTAAGTTCCTGCCACCCCGGTACTCCTGCCAGATTCTCA |

-continued

| SEQ ID NO. | DESIGNATION | SOURCE | TYPE | SEQUENCE |
|---|---|---|---|---|
| | | | | GGCTCCCTGCTTGGAGGCAAGGCTGCCCTCACCCTCTCAGGGGTACAGCCAGGAGGATGAGGCAGA |
| | | | | ATATTACTGTGTTCTATGGTACAGCAACCCTGGGTGTTCGGTGGAGGAACCAAACTGACTGTCC |
| | | | | TA |
| 163. | VH-P of F12Q | artificial | aa | EVQLLESGGGLVQPGGSLKLSCAASGFTFNSYAMNWVRQAPGKGLEWVARIRSKYNNYATYYADS |
| | | | | VKGRFTISRDDSKNTAYLQMNNLKTEDTAVYYCVRHGNFGNSYVSWAYWGQGTLVTVSS |
| 164. | VH-P of F12Q | artificial | nt | GAGGTGCAGCTGCTCGAGTCTGGAGGAGGATTGGTGCAGCCTGGAGGGTCATTGAAACTCTCATG |
| | | | | TGCAGCCCTCTGATTCACCTTCAATAGCTACGCCATGAACTGGGTCCGCCAGGCTCCAGGAAAGG |
| | | | | GTTTGGAATGGGTTGCTCGCATAAGAAGTAAATATTAATAATTATGCAGATAGCGTCGTCAAGGG |
| | | | | GTGAAGGCAGGTTCACCATCTCCAGAGATGATTCAAAAAACACTGCTATCTACAAATGAACAA |
| | | | | CTTGAAAACTGAGGACACTGCCGTGTACTACTGTGTGAGACATGGAACTTCGGTAATAGCTACG |
| | | | | TTTCCTGGGCTTACTGGGGCCAAGGGACTCTGGTCACCGTCTCA |
| 165. | VL-P of F12Q | artificial | aa | ELVLTQEPSLTVSPGGTVTLTCGSSTGAVTSGNYPNWVQQKPGQAPRGLIGGTKFLAPGTPARFS |
| | | | | GSLLGGKAALTLSGVQPEDEAEYYCVLWYSNRWVFGGGTKLTVL |
| 166. | VL-P of F12Q | artificial | nt | GAGCTCGTTGACTCAGGAACCTTCACTCACCGTATCACCTGTGGAACAGTCACACTCACTTG |
| | | | | TGGCTCCTCCACTGGGGCTGTTACATCTGGCAACTAGGTCCCCAAACTGGGTCCAACAAAAACCAGTC |
| | | | | AGGACACCCGGTCTAATAGGTGGGACTAAGTTCCTGCCCCGGTACTCCTGCCAGATCTCA |
| | | | | GGCTCCCTGCTTGGAGGCAAGGCTGCCCTCACCCTCTCAGGGGTACAGCCAGGAGGATGAGGCAGA |
| | | | | ATATTACTGTGTTCTATGGTACAGCAACCCTGGGTGTTCGGTGGAGGAACCAAACTGACTGTCC |
| | | | | TA |
| 167. | VH-VL of F12Q | artificial | aa | EVQLVESGGGLVQPGGSLKLSCAASGFTFNSYAMNWVRQAPGKGLEWVARIRSKYNNYATYYADS |
| | | | | VKGRFTISRDDSKNTAYLQMNNLKTEDTAVYYCVRHGNFGNSYVSWAYWGQGTLVTVSSGGGGS |
| | | | | GGGGSGGGGSQTVVTQEPSLTVSPGGTVTLTCGSSTGAVTSGNYPNWVQQKPGQAPRGLIGGTKF |
| | | | | LAPGTPARFSGSLLGKAALTLSGVQPEDEAEYYCVLWYSNRWVFGGGTKLTVL |
| 168. | VH-VL of F12Q | artificial | nt | GAGGTGCAGCTGCTCGAGTCTGGAGGAGGATTGGTGCAGCCTGGAGGGTCATTGAAACTCTCATG |
| | | | | TGCAGCCCTCTGATTCACCTTCAATAGCTACGCCATGAACTGGGTCCGCCAGGCTCCAGGAAAGG |
| | | | | GTTTGGAATGGGTTGCTCGCATAAGAAGTAAATATAATTATGCAACATATTATGCCGATTCA |
| | | | | GTGAAAGGCAGGTTCACCATCTCCAGAGATGATTCCAAGAATACAGCTTATCTACAAATGAACAA |
| | | | | CTTGAAAACTGAGGACACTGCCGTGTACTACTGTGTGAGACATGGAACATGGGAACTTCGGTAATAGCTACG |
| | | | | TTTCCTGGGCTTACTGGGGCCAAGGGACTCTGGTCACCGTCTCCTCAGGGGCTGGTGGTGGTTCT |
| | | | | GGCGGCGGCGGCTCCGGTGGTGGTGGATCACAGACAGTTGTGACTCAGGAACCTTCACTCTGGCAACT |
| | | | | ATCACCTGTGGAACAGTCACAAAAACCAGGTCAGGCACCCCGGTCTAATAGGTGGACTAAGTTC |
| | | | | CTCGCCCCGGTACTCCTGCCAGATTCTCAGGCTCCCTGGAGGCAAGGCTGCCCTCACCCT |
| | | | | CTCAGGGGTACAGCCAGGAGGATGAGGCAGAATATTACTGTGTTCTATGGTACAGCAACCGCTGGG |
| | | | | TGTTCGGTGGAGGAACCAAACTGACTGTCCTA |
| 169. | VH-VL-P of F12Q | artificial | aa | EVQLLESGGGLVQPGGSLKLSCAASGFTFNSYAMNWVRQAPGKGLEWVARIRSKYNNYATYYADS |
| | | | | VKGRFTISRDDSKNTAYLQMNNLKTEDTAVYYCVRHGNFGNSYVSWAYWGQGTLVTVSSGGGGS |
| | | | | GGGGSGGGGSELVVTQEPSLTVSPGGTVTLTCGSSTGAVTSGNYPNWVQQKPGQAPRGLIGGTKF |
| | | | | LAPGTPARFSGSLLGGKAALTLSGVQPEDEAEYYCVLWYSNRWVFGGGTKLTVL |
| 170. | VH-VL-P of F12Q | artificial | nt | GAGGTGCAGCTGCTCGAGTCTGGAGGAGGATTGGTGCAGCCTGGAGGGTCATTGAAACTCTCATG |
| | | | | TGCAGCCCTCTGATTCACCTTCAATAGCTACGCCATGAACTGGGTCCGCCAGGCTCCAGGAAAGG |
| | | | | GTTTGGAATGGGTTGCTCGCATAAGAAGTAAATATAATTATGCAACATATTATGCCGATTCA |
| | | | | GTGAAAGGCAGGTTCACCATCTCCAGAGATGATTCAAAAAACACTGCTATCTACAAATGAACAA |

-continued

| SEQ ID NO. | DESIGNATION | SOURCE | TYPE | SEQUENCE |
|---|---|---|---|---|
| | | | | CTTGAAAACTGAGGACACTGCCGTGTACTACTGTGTGAGACATGGGAACTTCGGTAATAGCTACG<br>TTTCCTGGTGGGCTTACTGGGGCCAAGGACTTCTGAGCTCTCCAGGTGCTGGTGGTTCT<br>GGCGGCGGCGGCTCCGGTGCTGGTTCTGAGCTCGTGTGACTCGGGCTGTGACTCACTCACCGT<br>ATCACCTGGTGGAACAGTCACACTCACTTGTGCCTCCGACTGGGCTGTTACATCTGGCAACT<br>ACCCAAACTGGGTCCAACAAAAACCAGGTCAGGCACCTCCGGTCTAATAGGTGGACTAAGTTC<br>CTCGCCCCCGTACTCCTGCAGATTCTCAGGCTGCAGAATATTACTGTGTTCTATGGTACAACCT<br>CTCAGGGGTACAGCCAGAGGATGAGGCAGAATATTACTGTGTTCTATGGTACAGCAACCGCTGGG<br>TGTTCGGTGGAGGAACCAAACTGACTGTCCTA |
| 171. | CDR-L1 of I2C | artificial | aa | GSSTGAVTSGNYPN |
| 172. | CDR-L2 of I2C | artificial | aa | GTKFLAP |
| 173. | CDR-L3 of I2C | artificial | aa | VLWYSNRWV |
| 174. | CDR-H1 of I2C | artificial | aa | KYAMN |
| 175. | CDR-H2 of I2C | artificial | aa | RIRSKYNNYATYYADSVKD |
| 176. | CDR-H3 of I2C | artificial | aa | HGNFGNSYISYWAY |
| 177. | VH of I2C | artificial | aa | EVQLVESGGGLVQPGGSLKLSCAASGFTFNKYAMNWVRQAPGKGLEWVARIRSKYNNYATYYADS<br>VKDRFTISRDDSKNTAYLQMNNLKTEDTAVYYCVRHGNFGNSYISYWAYWGQGTLVTVSS |
| 178. | VH of I2C | artificial | nt | GAGGTGCAGCTGGTCGAGTCTGGAGGAGGATTGGTGCAGCCTGGAGGGTCCCTGAAACTCTCATG<br>TGCAGCCTCTGGATTCACCTTCAATAAGTACGCCATGAACTGGGTCCGCCAGGCTCCAGGAAAGG<br>GTTTGGAATGGTTGCTCGCATAAGAAGTAAATATATTATGCAACATATTATGCCGATTCA<br>GTGAAAGACAGGTTCACCATCTCCAGAGATGATTCAAAAAACACTGCCTATCTACAAATGAACAA<br>CTTGAAAACTGAGGACACTGCCGTGTACTACTGTGTGAGACATGGGAACTTCGGTAATAGCTACA<br>TATCCTACTGGGCTTACTGGGGCCAAGGGACTCTGGTCACCGTCTCCTCA |
| 179. | VL of I2C | artificial | aa | QTVVTQEPSLTVSPGGTVLTCGSSTGAVTSGNYPNWVQQKPGQAPRGLIGGTKFLAPGTPARFS<br>GSLLGGKAALTLSGVQPEDEAEYYCVLWYSNRWVFGGGTKLTVL |
| 180. | VL of I2C | artificial | nt | CAGACTGTTGTGACTCAGGAGCCTTCACTCACCGTATCACCTGGTGGAACAGTCACACTCACTTG<br>TGGCTCCTCCGACTGGGCTGTTAATAGGTGGACTAAGTTCCTCGCCCCCGTACTCCTGCCAGATTCTCA<br>AGGCACCCCTGCTTGGCAAGGCTGCCAACCGCTGGGGTGTTCGGTGGAGGAACCAAACTGACTGTCC<br>GGCTCCCTGGCTCCTTGGACCAAGGCTGCCACAACCGCTGGGGTGTTCGGTGGAGGAACCAAACTGACTGTCC<br>ATATTACTGTGTTCTATGGTACAGCAACCGCTGGGGTGTTCGGTGGAGGAACCAAACTGACTGTCC<br>TA |
| 181. | VH-P of I2C | artificial | aa | EVQLLESGGGLVQPGGSLKLSCAASGFTFNKYAMNWVRQAPGKGLEWVARIRSKYNNYATYYADS<br>VKDRFTISRDDSKNTAYLQMNNLKTEDTAVYYCVRHGNFGNSYISYWAYWGQGTLVTVSS |
| 182. | VH-P of I2C | artificial | nt | GAGGTGCAGCTGCTCGAGTCTGGAGGAGGATTGGTGCAGCCTGGAGGGTCCCTGAAACTCTCATG<br>TGCAGCCTCTGGATTCACCTTCAATAAGTACGCCATGAACTGGGTCCGCCAGGCTCCAGGAAAGG<br>GTTTGGAATGGGTTGCTCGCATAAGAAGTAATATATATTATGCAACATATTATGCCGATTCA<br>GTGAAAGACAGGTTCACCATCTCCAGAGATGATTCAAAAAACACTGCCTATCTACAAATGAACAA<br>CTTGAAAACTGAGGACACTGGGCTTACTGGGGCCAAGGGACTCTGGTCACCGTCTCCTCA<br>TATCCTACTGGGCTTACTGGGGCCAAGGGACTCTGGTCACCGTCTCCTCA |

| SEQ ID NO. | DESIGNATION | SOURCE | TYPE | SEQUENCE |
|---|---|---|---|---|
| 183. | VL-P of I2C | artificial | aa | ELVVTQEPSLTVSPGGTVLTCGSSTGAVTSGNYPNWVQQKPGQAPRGLIGGTKFLAPGTPARFS GSLLGGKAALTLSGVQPEDEAEYYCVLWYSNRWVFGGGTKLTVL |
| 184. | VL-P of I2C | artificial | nt | GAGCTCGTTGTGACTCAGGAACCTTCACTCACCGTATCACCTGGTGAACAGTCACACTCACTTG TGGCTCCTCGACTGGGGCTGTTACATCTGGCAATTACTACCCAAACTGGGTCCAACAAAACCAGGTC AGGCACCCCGTGGTCTAATAGGTGGGACTAAGTTCTCCTCGCCCCCGTACTCCTGCCAGATTCTCA GGCTCCCTGCTTGGAGGCAAGGCTGCCCTAACCCTGTCGGTGTTCGGTGGAGGAACCAAACTGACTGTCC TA |
| 185. | VH-VL of I2C | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLWYSNRWVFGGGTKLTVL |
| 186. | VH-VL of I2C | artificial | nt | GAGGTGCAGCTGGTCGAGTCTGGAGGAGGATTGGTCGAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATTATGCCACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGAACTTCGGTAATAGCTACA TATCCTACTGGGCTTACTGGGGTCCAGGGAACCCTGGTCACCGTCTCCTCAGGTGGTGGTGGTTCT GGCGGCGGCGGCTCCGGTGGTGGTGGATCTCAGACTGTGTGACTCAGGAGCCTTCACTCACCGT ATCACCTGGTGGAACAGTCACACTTGGGCTCCTCGACTGGGGTCTAATAGGTGGGACTAAGTTC ACCCAAACTGGGTCCAACAAAACCAGGTCAGGACCCCGTGTCTAATAGGTGGGACTAAGTTC CTCGCCCCCGTACTCCTGCCAGATTCTCAGGCTCCCTGCTTGGAGGCAAGGCTGCCCTCACCCT CTCAGGGGTACAGCCAGAGGATGAGGCAGAATATTACTGTGTTCTATGGTACAGCAACCCTGGG TGTTCGGTGGAGGAACCAAACTGACTGTCCTA |
| 187. | VH-VL-P of I2C | artificial | aa | EVQLLESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSELVVTQEPSLTVSPGGTVLTCGSSTGAVTSGNYPNWVQQKPGQAPRGLIGGTKF LAPGTPARFSGSLLGGKAALTLSGVQPEDEAEYYCVLWYSNRWVFGGGTKLTVL |
| 188. | VH-VL-P of I2C | artificial | nt | GAGGTGCAGCTGCTCGAGTCTGGAGGAGGATTGGTCGAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATTATGCCACATATTATGCCGATTCA GTGAAAGACAGGTTCACCATCTCCAGAGATGATTCAAAAAACACTGCCTATCTACAAATGAACAA CTTGAAAACTGAGGACACTGCCGTGTACTACTGTGTGAGACATGGAACTTCGGTAATAGCTACA TATCCTACTGGGCTTACTGGGGTCCAGGGAACCCTGGTCACCGTCTCCTCAGGTGGTGGTGGTTCT GGCGGCGGCGGCTCCGGTGGTGGTGGATCTGAGCTCGTTGTGACTCAGGAGCCTTCACTCACCGT ATCACCTGGTGGAACAGTCACACTTGGGCTCCTCGACTGGGGTCTAATAGGTGGGACTAAGTTC ACCCAAACTGGGTCCAACAAAACCAGGTCAGGCACCCCGTGGTCTAATAGGTGGGACTAAGTTC CTCGCCCCCGTACTCCTGCCAGATTCTCAGGCTCCCTGCTTGGAGGCAAGGCTGCCCTCACCCT CTCAGGGGTACAGCCAGAGGATGAGGCAGAATATTACTGTGTTCTATGGTACAGCAACCCTGGG TGTTCGGTGGAGGAACCAAACTGACTGTCCTA |
| 189. | MCSP-G4 VH-VL x H2C VH-VL | artificial | aa | QVQLVQSGAEVKRPGASMKVSCKASGYTFTNYYIHWVRQAPGQGLEWMGWINPNSGATNYAQKFQ GRVTMTRDTISTSTVYMELSSLRSEDTAVYYCAKSWSWFASWGQGTLVTVSSGGGGSGGGGSGGG GSDIVMTQSPDSLAVSLGERATINCKSSQSVLNSSNNRNYLAWYQQKPGQPPKLLIYWASTRESG VPDRPSGSGSGTDFTLTISGLQAEDVAVYYCQQHYSTPFTFGPGTKVDIKSGGGGSEVQLVESGG GLVQPGGSLKLSCAASGFTFNKYAMNWVRQAPGKGLEWVARIRSKYNNYATYYADSVKDRFTISR |

| SEQ ID NO. | DESIGNATION | SOURCE | TYPE | SEQUENCE |
|---|---|---|---|---|
| | | | | DDSKNTAYLQMNNLKTEDTAVYYCVRHGNFGNSYISYNAYWGQGTLVTVSSGGGGSGGGGSGGGGS SQTVVTQEPSLTVSPGGTVTLTCGSSTGAVTSGYYPNWVQQKPGQAPRGLIGGTKFLAPGTPARF SGSLLGGKAALTLSGVQPEDEAEYYCALWYSNRWVFGGGTKLTVL |
| 190. | MCSP-G4 VH-VL x H2C VH-VL | artificial | nt | CAGGTGCAGCTGGTCCAGTCTGGGGCTGAGGTGAAGAGGCCTGGGGCCTCAATGAAGGTCTCCTG CAAGGCTTCTGGATACACCTTCACCAACTACTATATACACTGGGTGCGACAGGCCCCTGGACAAG GTCTTGAGTGGATGGGTTGGATCAACCCAACAGTGGTGCCACAAACTATGCACAGAAGTTCAG GCCAGAGTCACCATGACCAGGGACACGTCCACGAGCACAGTCTACATGGAGCTGAGCAGCCTGAG ATCTGAGGACACGGCCGTCTATTACTGTGCGAAATCCTGGTCTTGGCGCGGCAGTCTTCCTGGTTC AAGGAACCTTGGTCACCGTCTCCAGTGGTGGTGGATCCCAGAGTGTTTTAAACAGCTCCAACAGTCTCC CATCAACTGCAAGTCCAGCCAGGACAGCCTCCTAAGCTGCTCATTTACTGGGCATCTACCCGGGAATCCGGG GTCCCTGACCGATCAGTGCCAGTTTATTACTGCAGACAGATTTACTTGCCACCATCAGTGCCTGCA GGCTGAAGATGTGCAGCTTGATATCAAATCCGGAGGTGTGATCTCATGTCCAGCTGGTCAGTCTGGAGGA GGATTGGTGCAGCCTGGAGGGTCCATTGAAACTTCTGGAGGGGTTTGGAATGGGTCTGCATAAGAA GTACGCCATGAACTGGGTCCCAGGCTCCAGGATTACTGGCTACCCGTATCAGTGAAAGACACAGTTCACCATCTCCAGA GATGATTCAAAAAACACTGCCTATCTACAAATGAACACTGGAGGACAACTCCTGTGAAGACTGGAGGAGGAC CTACTGTGGTGAGAGCAATGGGACATGGAAACTCTGGTTGGTTCTGGCGGTCTCCGGTGGTGGTGGTGGATCCTG GGACTCTGGTCACCGTCTCCAGTGGCTCCTCCAGGGCTCTGGCACCAGGTCCACCTGGACAGTCACACTCAC TCTCAGACTGTGTGACTGGGCTGTTAATAGGTGGGACTAAGGTTCTACCACTCCTCACTGCCAGATTC GTCAGGCACCCGGTGTCTTATGATGGTACAGCACCGTGGGTTCCTGTGAGACAAGCTGGGAGGCGGCTCGGGCCAGGATTCTGCCAGATGACGCCAGCGAAGGCAGCGGACACCTGGCTACAGCTCCAACAAACAAAACCAG TCAGGCTCCCTGTTGGAGGCAAGGCTGCCTCCAGGGTACGCTTGGAGGATGGGCT AGAATATTACTGTGCTCTATGGTACAACCGCTGGGTGTTCGGTGGAGGAACCAAACTGACTG TCCTA |
| 191. | MCSP-G4 VH-VL x F12Q VH-VL | artificial | aa | QVQLVQSGAEVKRPGASMKVSCKASGYTFTNYYIHWVRQAPGQGLEWMGWINPNSGATNYAQKFQ GRVTMTRDTSTSTVVMELSSLRSEDTAVYYCAKSWVSWPASWGQQTLVTVSSGGGGSGGGGSGGGG GSDIVMTQSPDSLAVSLGERATINCKSSQSVLNSSNRNYLAWYQQKPGQPPKLLIYWASTRESG VPDRFSGSGSGTDFTLTISGLQAEDVAVYYCQQHYSTPFTFGPGTKVDIKSGGGGSEVQLVESG GLVQPGGSLKLSCAASGFTFNSYAMNWVRQAPGKGLEWVARIRSKYNNYATYYADSVKGRFTISR DDSKNTAYLQMNNLKTEDTAVYYCVRHGNFGNSYVSWNAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 192. | MCSP-G4 VH-VL x F12Q VH-VL | artificial | nt | CAGGTGCAGCTGGTCCAGTCTGGGGCTGAGGTGAAGAGGCCTGGGGCCTCAATGAAGGTCTCCTG CAAGGCTTCTGGATACACCTTCACCAACTACTATATACACTGGGTGCGACAGGCCCCTGGACAAG GTCTTGAGTGGATGGGTTGGATCAACCCAACAGTGGTGCCACAAACTATGCACAGAAGTTCAG GCCAGAGTCACCATGACCAGGGACACGTCCACGAGCACAGTCTACATGGAGCTGAGCAGCCTGAG ATCTGAGGACACGGCCGTCTATTACTGTGCGAAATCCTGGTCTTGGCGCGGCAGTCTTCCTGGTTC AAGGAACCTTGGTCACCGTCTCCAGTGGTGGTGGATCCCAGGCGCTGTCTCTGGCGAGGGCCAC CATCAACTGCAAGTCCAGCCAGGACAGCCTCCTAAGCTGCTCATTTACTGGGCATCTACCCGGGAATCCGGG ACCAGAGAAACCAGGACAGCCCTCCTAAGCTGCTCATTTACTGGGCATCTACCCGGGAATCCGGG GTCCCTGACCGATTCAGTGCCAGTTTATTACTGCAGACAGATTTACTTGCCACCATCAGTGCCTGCA GGCTGAAGATGTGGCAGTTGATATCAAATCCGGAGGTGTGATCAACAACATTATAGTACTCCGAGGTGCAGCTGCAGCTGGAGGA GGACCAAGGTGCAGCTTGGAGGGTCCATTGAAACTCTCACTTGTGCAGCCTCTGGATTCACCTTCAGTAG |

| SEQ ID NO. | DESIGNATION | SOURCE | TYPE | SEQUENCE |
|---|---|---|---|---|
| | | | | CTACGCCATGAACTGGGTCCGCCAGGCTCCAGGAAAGGGTTTGGAATGGGTTGCTCGCATAAGAA<br>GTAAATATAATAATTATGCAACATATTATCCGGATTCAGTGAAGGGCAGGTTCACCATTCCGTGA<br>GATGATTCAAAAAACACTGCCTATCTACAAATGAACAACTGAGGACACTGAGGATCTCGCGTGA<br>CTATGTGTCTGAGACATGGAACATGCGTAATAGCTACGTTTCCTGGTGGCGCTCCGTGGTGTGT<br>GGACTCTGGTCACCGTCTCCAGTGGTGGTGGTGGTTCTGGCGGCGGCGGCTCCGGTGGTGGTGGT<br>TCTCAGACTGTTGTGACTCAGGAGCCTTCACTCTGCGAACTGCAGACCTGGTGAACAGTCACTCAC<br>TTGTGGCTCCTGGACTGGGCTGTTAATAGGCTGGACTAAGTTCTCGCCCCAGGGATCCGCGATTC<br>TCAGGCCACCCCGTGTCTTGGAGCAAGGCTGCCCTTCACCGCTGGTGTTCGCTCAGGACTGGC<br>AGAATATTACTGTGTTCTATGGTACAGCACCGCGTGGGTTCGCGGCTGTCGAGACGAAACTGACTG<br>TCCTA |
| 193. | MCSP-G4 VH-VL x<br>I2C VH-VL | artificial | aa | QVQLVQSGAEVKRPGASMKVSCKASGYTFTNYYIHWVRQAPGQGLEWMGWINPNSGATNYAQKFQ<br>GRVTMTRDTSTSTVYMELSSLRSEDTAVYYCAKSWVSWFASWGQGTLVTVSSGGGGSGGGGSGG<br>GSDIVMTQSPDSLAVSLGERATINCKSSQSVLNSSNNRNYLAWYQQKPGQPPKLLIYWASTRESG<br>VPDRFSGSGSGTDFLTISGLQAEDVAVYYCQQHYSTPFTFGPGTKVDIKSGGGGSEVQLVESGG<br>GLVQPGGSLKLSCAASGFTFNKYAMNWVRQAPGKGLEWVARIRSKYNNYATYYADSVKDRFTISR<br>DDSKNTAYLQMNNLKTEDTAVYYCVRHGNFGNSYISYWAYWGQGTLVTVSSGGGGSGGGGGSGG<br>SQTVVTQEPSLTVSPGGTVTLTCGSSTGAVTSGNYPNWVQQKPGQAPRGLIGGTKFLAPGTPARF<br>SGSLLGGKAALTLSGVQPEDEAEYYCVLWYSNRWVFGGGTKLTVL |
| 194. | MCSP-G4 VH-VL x<br>I2C VH-VL | artificial | nt | CAGGTGCAGCTGGTCCAGTCTGGGGCTGAGGTGAAGAGGCCTGGGCTCAATGAAGGTCTCCTG<br>CAAGGCTTCTGAGTGGATGGGTTGGATCAACCTAACGTGGTGCCACAAATATGCACAGAAGTTCAG<br>GGCAGAGTGACCATGACCAGGGACACGTCCACGAGCACAGTCTACATGGAGCTCAGCCTGAG<br>ATCTGAGGACACGGCCGTCTATTACTGTGCGAAATCTGGTGGTTCTGCCGGCGGTCCGGTGT<br>AAGGAACCTTGGTCACCGTCTCCAGGTGGTGGTGGTGCCCTGGCTGTCTCTGGCGAGAGGCCAC<br>GGTTCTGATATCGTGATGACCCAGAGTGTTTTAAACAGCTCCAACAATAGGCAACTTAGCTTGT<br>ACCAGCAGAAAACCAGGACAGCCTCCTCATTACGTCTGGAGCATCTACCCGGAATCCGGG<br>GTCCCTGACCGATTCAGTGGCAGTTTATTACTGTCAGCAGACAATTATAGTACTCCATTCACTTTTGGCCCTG<br>GGCTGAAGATGTGGCAGTTTATTACTGTCAGCAACAATTATAGTACTCCATTCACTTTTGGCCCTG<br>GGACCAAAGTGGATATCAAATCCGGAGGTGTGATCCGAGGTGCAGCTGGTCGAGTCTGGAGGA<br>GGATTGGTGCAGCCTGGACGGTCATTGAAACTTCTCATGTGCAGCCTCTGGATTCACCTTCAATAA<br>GTACGCCATGAACTGGGTCCGCCAGGCTCCAGGAAAGGGTTTGGAATGGGTTGCTCGCATAAGAA<br>GTAAATATAATAATTATGCAACATATTATCCGGATTCAGTGAAGACTCGATTCACCATCTCCAGA<br>GATGATTCAAAAAACACTGCCTATCTACAAATGAACAACTGAGGACACTGCAGTATATCCTGAAA<br>CTACGCTGGGTGCACCCGTCTCCAGTGGTGGTGGTGGTTCTGGCGGCGGCGGCTCCGGTGGTGGT<br>GGACTCTGGTCACCGTCTCCAGTGGTGGTGGTGGTTCTGGCGGCGGCGGCTCCGGTGGTGGTGGT<br>TCTCAGACTGTTGTGACTCAGGAGCCTTCACTCTGCGAACTGCAGACCTGGTGAACAGTCACTCAC<br>TTGTGGCTCCTGGACTGGGCTGTTAATAGGCTGGACTAAGTTCTCGCCCCAGGGATCCGCGATTC<br>TCAGGCCACCCCGTGTCTTGGAGCAAGGCTGCCCTTCACCGCTGGTGTTCGCGGCTGTCGAGACGAAACTGACTG<br>AGAATATTACTGTGTTCTATGGTACAGCACCGCGTGGGTTCGCGGCTGTCGAGACGAAACTGACTG<br>TCCTA |
| 195. | MCSP-G4 VH-VL-P x<br>F6A VH-VL-P | artificial | aa | QVQLVQSGAEVKRPGASMKVSCKASGYTFTNYYIHWVRQAPGQGLEWMGWINPNSGATNYAQKFQ<br>GRVTMTRDTSTSTVYMELSSLRSEDTAVYYCAKSWVSWFASWGQGTLVTVSSGGGGSGGGGSGG<br>GSELVMTQSPDSLAVSLGERATINCKSSQSVLNSSNNRNYLAWYQQKPGQPPKLLIYWASTRESG<br>VPDRFSGSGSGTDFLTISGLQAEDVAVYYCQQHYSTPFTFGPGTKVDIKSGGGGSEVQLLESGG<br>GLVQPGGSLKLSCAASGFTFNIYAMNWVRQAPGKGLEWVARIRSKYNNYATYYADSVKSRFTISR |

-continued

| SEQ ID NO. | DESIGNATION | SOURCE | TYPE | SEQUENCE |
|---|---|---|---|---|
| | | | | DDSKNTAYLQMNNLKTEDTAVYYCVRHGNFGNSYVSFFAYWGQGTLVTVSSGGGGSGGGG<br>SELVVTQEPSLTVSPGGTVTLTCGSSTGAVTSGYYPNWVQQKPGQAPRGLIGGTKFLAPGTPARF<br>SGSLLGGKAALTLSGVQPEDEAEYYCALWYSNRWVFGGGTKLTVL |
| 196. | MCSP-G4 VH-VL-P x<br>F6A VH-VL-P | artificial | nt | CAGGTGCAGCTGGTCCAGTCTGGGGCTGAGGTGAAGAGGCCTGGGGCCTCAATGAAGGTCTCCTG<br>CAAGGCTTCTGGATACACCTTCACCAACTACTATATACACTGGGTGCGACAGGCCCCTGGACAAG<br>GTCTTGAGTGGATGGGTTGGATCAACCCTAACAGTGGTGCCACAAACTATGCACAGAAGTTCCAG<br>GGCAGAGTCACCATGACCAGGGACACGTCCACGAGCACAGTCTACATGGAGCTGAGCAGCCTGAG<br>ATCTGAGGACACGGCCGTCTATTACTGTGCGAAATCTCAGGTCTACATGGAGCTTGCTTCCGGGTC<br>AAGGAACCCTTGGTCACCGTCTCCAGTGGTGGTTCCCGAGACTCCCCTGGCGGTGGTGGTGGTTCT<br>GGTTCTGAGCTCGTGATGACCCAGAGTCCTTTAAACAGCTCCAACATTACTCAGCATTACTCCGG<br>CATCAACTGCAAGTCCAGCCAGAGCCTCCTAAGCTGCCATTTACTGCACAGATTTCACTCTCACCA<br>ACCAGCAGAAACCAGGACAGCCTCCTAAGCTGCTCATTTACTGCACAGATTTCACTCTCACCA<br>GTCCCTGACCAGTCAGTGCCAGTTTATTACTGTCAGCACAGATTATAGTGCAGCACTGCCGTGCA<br>GGCTGAAGATGTGGCAGTTTATTACTGTCAGCACAACATTATAGTACTCCAGTGCTGAATTCGGG<br>GGATTGGTGCAGCCTGGAGGGTCATTGAAACTCTCATGTGCAGCCTCTGGATTCACCTTCAATAT<br>CTACGCCATGAACTGGGTCCGCCAGGCTCCAGGGAAGGGTTTGGAATGGGTTGCTCGATAAGAAA<br>GCTGAAGATGGAATGGGATATATCAATCCGAGGTGTGATCTCAGAATCTCAGTCCAGTGGCCAAG<br>GATTGGTGCAGCCTGGAGGGTCATTGAAACTCTCATGTGCAGCCTCTGGATTCACCTTCAATAT<br>CTACGCCATGAACTGGGTCCGCCAGGCTCCAGGGAAGGGTTTGGAATGGGTTGCTCGATAAGAAA<br>GTAAATATAATATATATGCAACATATTATGCCGATTCAGTGAAGACAGTTCACCATTCCAGA<br>GATGATTCAAAAAACACTGCCTATCTACAAAATGAACAACTTGAAAGACACTGAGGACACTGCCGTGTA<br>CTACGCCGTGTATTACTGGGTCCAGGCTCTGGTTATTACTGCGGCTCTAATAGGGCGGTACCAGGCCCGGG<br>GGACTCTGGTCACCGTCTCCAGTGGTGGTTCTGGCGGTGGCGGATCGGGCGGTGGTGGGTCGGTGGT<br>TCTGAGCTCGTGTTGTGACTCAGGGACTGTAACTGTAATAGGTGGACTAAGTTCTCACCTGCCTATCCTG<br>TTGTGGCTCCTGACTGGGTCTTAATAGGTGGACTAAGTTCTCACCTCGCCCCGTACTCCTGCCAGAT<br>TCAGGCACCCCGTGTCTTGAGCACCTTCAGGGTACGCAAGGCTGCCTCTCAGGGTACCAGCAGGATGGGGGCT<br>AGAATATTACTGTCTATGGTACAGCAACCGTGGGTTCCGTGGAGGAACCAAACTGACTG<br>TCCTA |
| 197. | MCSP-G4 VH-VL-P x<br>H2C VH-VL-P | artificial | aa | QVQLVQSGAEVKRPGASMKVSCKASGYTFTNYYIHWVRQAPGQGLEWMGWINPNSGATNYAQKFQ<br>GRVTMTRDTSTSTVYMELSSLRSEDTAVYYCAKSWVSWFASWGQGTLVTVSSGGGGSGGGGSGGGG<br>GSELVMTQSPDSLAVSLGERATINCKSSQSVLNSSNNRNYLAWYQQKPGQPPKLLIYWASTRESG<br>VPDRFSGSGSGTDFTLTISGLQAEDVAVYYCQQHYSTPFTFGPGTKVDIKSGGGGSEVQLLESGG<br>GLVQPGGSLKLSCAASGFTFNKYAMNWVRQAPGKGLEMVARIRSKYNNYATYYADSVKDRFTISR<br>DDSKNTAYLQMNNLKTEDTAVYYCVRHGNFGNSYISWAYWGQGTLVTVSSGGGGSGGGGSGGGG<br>SELVVTQEPSLTVSPGGTVTLTCGSSTGAVTSGYYPNWVQQKPGQAPRGLIGGTKFLAPGTPARF<br>SGSLLGGKAALTLSGVQPEDEAEYYCALWYSNRWVFGGGTKLTVL |
| 198. | MCSP-G4 VH-VL-P x<br>H2C VH-VL-P | artificial | nt | CAGGTGCAGCTGGTCCAGTCTGGGGCTGAGGTGAAGAGGCCTGGGGCCTCAATGAAGGTCTCCTG<br>CAAGGCTTCTGGATACACCTTCACCAACTACTATATACACTGGGTGCGACAGGCCCCTGGACAAG<br>GTCTTGAGTGGATGGGTTGGATCAACCCTAACAGTGGTGCCACAAACTATGCACAGAAGTTCCAG<br>GGCAGAGTCACCATGACCAGGGACACGTCCACGAGCACAGTCTACATGGAGCTGAGCAGCCTGAG<br>ATCTGAGGACACGGCCGTCTATTACTGTGCGAAATCTCCTGGTTTGCTTCTCCGGGGTC<br>AAGGAACCCTTGGTCACCGTCTCCAGTGGTGGTTCCCGAGACTCCCCTGGCGGTGGTGGTGGTTCT<br>GGTTCTGAGCTCGTGATGACCCAGAGTCCTTTAAACAGCTCCAACATTACTCAGCATTACTTAGT<br>CATCAACTGCAAGTCCAGCCAGAGCCTCCTAAGCTGCTCATTTACTGCACAGATTTCACTCTCACCA<br>ACCAGCAGAAACCAGGACAGCCTCCTAAGCTGCTCATTTACTGCACAGATTTCACTCTCACCA<br>GTCCCTGACCAGTCAGTGCCAGATTCAGTGCACAGATTTCACTCTCACCA<br>GGCTGAAGATGTGGCAGTTTATTACTGTCAGCACAACATTATAGTACTCCAGTGCTGAATTCGGG<br>GGACCAAACTGAACTGGGTCCAGCCTCGAGGGTCATTGAAACTCTCATGTGCAGCCTCTGGATTCACCTTCAATAA |

| SEQ ID NO. | DESIGNATION | SOURCE | TYPE | SEQUENCE |
|---|---|---|---|---|
| | | | | GTACGCCATGAACTGGGTCCGCCAGGCTCCAGGAAAGGGTTTGGAATGGGTTGCTCGCATAAGAA |
| | | | | GTAAATATAATAAATCAAAAACACTGCCTATCTACAACATTCGGTAATAGCTACACATATCCTAC |
| | | | | GATGATTCAAAAACACTGCCTATCTACAACATTCGGTAATAGCTACACATATCCTACTGGGCCAAG |
| | | | | CTACTGTGTGAGACATGGAACTTGTGACTGGGCTGTTAATAGTGGACTAAGTTCTCGCCCGTGTA |
| | | | | GGACTCTGGTCACCGTCTCCAGGTGGTTCTGGCGGCGGCGGCTCCGGTGGTGGTGGT |
| | | | | TCTGAGCTCGTTGTGACTCAGGGCTGTTAATAGTGGGACTAAGTTCTCGCCCGTGTAGT |
| | | | | TTGTGGCTCCTCGACCCGTGTCTAATAGTGGGACTAAGTTCTCGCCCGTGTCAACAAAACCAG |
| | | | | GTCAGGCACCCCGTGTCTAATAGTGGGACTAAGTTCTCGCCCGTGTCAGCCAGAGGATGAGGC |
| | | | | TCAGGCTCCCTGCTTGGAGGCAAGGCTGCCCTCCACCCGCTGGGTGTTCGGTGGAGGAACCAAACTGACTG |
| | | | | AGAATATTACTGTCTCTATGGTACAGCAACCGCTGGGTGTTCGGTGGAGGAACCAAACTGACTG |
| | | | | TCCTA |
| 199. | MCSP-G4 VH-VL-P x H1E VH-VL-P | artificial | aa | QVQLVQSGAEVKRPGASMKVSCKASGYTFTNYYIHWVRQAPGQGLEWMGWINPNSGATNYAQKFQ |
| | | | | GRVTMTRDTSTSTVYMELSSLRSEDTAVYYCAKSWVSWFASWGQGTLVTVSSGGGGSGGGGSGG |
| | | | | GSELVMTQSPDSLAVSLGERATINCKSSQSVLNSSNNRNYLAWYQQKPGQPPKLLIYWASTRESG |
| | | | | VPDRFSGSGSGTDFTLTISGLQAEDVAVYYCQQHYSTPFTFGPGTKVDIKSGGGGSEVQLLESGG |
| | | | | GLEQPGGSLKLSCAASGFTFNSYAMNWVRQAPGKGLEWVARIRSKYNNYATYYADSVKGRFTISR |
| | | | | DDSKNTAYLQMNNLKTEDTAVYYCVRHGNFGNSYLSFWAYWGQGTLVTVSSGGGGSGGGGS |
| | | | | SELVVTQEPSLTVSPGGTVTLTCGSSTGAVTSGYYPNWVQQKPGQAPRGLIGGTKFLAPGTPARF |
| | | | | SGSLLGGKAALTLSGVQPEDEAEYYCALWYSNRWVFGGGTKLTVL |
| 200. | MCSP-G4 VH-VL-P x H1E VH-VL-P | artificial | nt | CAGGTGCAGCTGGTCCAGTCTGGGGCTGAGGTGAAGAGGCCTGGGGCCTCAATGAAGGTCTCCTG |
| | | | | CAAGGCTTCTGAGTGCACCTTCACCAACTACTATATACACTGGGTGCGACAAG |
| | | | | GTCTTGAGTGGATGGGTTGGATCAACCTAACAGTGGTGCCACAAACTATGCACAGAAGTTCCAG |
| | | | | GGCAGAGTGCACCATGACCAGGGACACGTCCACGAGCACAGTCTACATGGAGCTCAGCCTGAG |
| | | | | ATCTGAGGACACGGCCGTGTATTACTGTGCGAAATCTGGTCTCCTGTTTGCTTGCTCGGGTC |
| | | | | AAGGAACCTTGGTCACCGTCTCAGGTGGTGGTGGTTCTGGCGGCGGCGGCTCCGGTGGTGGT |
| | | | | GGTTCTGAGCTCGTGATGACCCAGAGTGTTTTAAACAGCTCCACAATAGGAACTAGTTGGT |
| | | | | CATCAACTGCAAGTCAGCCAGAGTGTTTTAAACAGCTCCACAATAGGAACTAGTTGGT |
| | | | | ACCAGCAGAAACCAGGACAGCCTCCTAAGGCTCCTCATTTACTGGGCATCTACCCGGAATCCGGG |
| | | | | GTCCCTGACCGATTCAGTGGCAGCGGGTCTGGGACAGATTTCACTCTCACCATCAGTGGCCTGCA |
| | | | | GGCTGAAGATGTGGCAGTTTATTACTGTCAGCAACATTATAGTACTCCATTCACTTTTGGCCCTG |
| | | | | GGACCAAAGTGGATATCAAATCCGGAGGTGGATCCGAGGTGCAGCTGCTCGAGTCTGGAGGA |
| | | | | GGATTGGAGCAGCCTGGAGGGTCATTGAAACTTCATGTGCAGCCTCTGGATTCACCTTCAATTC |
| | | | | GTACGCCATGAACTGGGTCCGCCAGGCTCCAGGAAAGGGTTTGGAATGGGTTGCTCGCATAAGA |
| | | | | GTAAATATAATAAATCAAAAACACTGCCTATCTACAACATTCGGTAATAGCTACACATATCCTAC |
| | | | | GATGATTCAAAAACACTGCCTATCTACAACATTCGGTAATAGCTACACATATCCTACTGGGCCAAG |
| | | | | CTACTGTGTGAGACATGGAACTTGTGACTGGGCTGTTAATAGTGGACTAAGTTCTCGCCCGTGTA |
| | | | | GGACTCTGGTCACCGTCTCCAGGTGGTTCTGGCGGCGGCGGCTCCGGTGGTGGTGGT |
| | | | | TCTGAGCTCGTTGTGACTCAGGGCTGTTAATAGTGGGACTAAGTTCTCGCCCGTGTCAAGT |
| | | | | TTGTGGCTCCTCGACCCGTGTCTAATAGTGGGACTAAGTTCTCGCCCGTGTCAACAAAACCAG |
| | | | | GTCAGGCACCCCGTGTCTAATAGTGGGACTAAGTTCTCGCCCGTGTCAGCCAGAGGATGAGGC |
| | | | | TCAGGCTCCCTGCTTGGAGGCAAGGCTGCCCTCCACCCGCTGGGTGTTCGGTGGAGGAACCAAACTGACTG |
| | | | | AGAATATTACTGTCTCTATGGTACAGCAACCGCTGGGTGTTCGGTGGAGGAACCAAACTGACTG |
| | | | | TCCTA |
| 201. | MCSP-G4 VH-VL-P x G4H VH-VL-P | artificial | aa | QVQLVQSGAEVKRPGASMKVSCKASGYTFTNYYIHWVRQAPGQGLEWMGWINPNSGATNYAQKFQ |
| | | | | GRVTMTRDTSTSTVYMELSSLRSEDTAVYYCAKSWVSWFASWGQGTLVTVSSGGGGSGGGGSGG |
| | | | | GSELVMTQSPDSLAVSLGERATINCKSSQSVLNSSNNRNYLAWYQQKPGQPPKLLIYWASTRESG |
| | | | | VPDRFSGSGSGTDFTLTISGLQAEDVAVYYCQQHYSTPFTFGPGTKVDIKSGGGGSEVQLLESGG |
| | | | | GLVQPGGSLKLSCAASGFTFNRYAMNWVRQAPGKGLEWVARIRSKYNNYATYYADSVKGRFTISR |

| SEQ ID NO. | DESIGNATION | SOURCE | TYPE | SEQUENCE |
|---|---|---|---|---|
| 202. | MCSP-G4 VH-VL-P x G4H VH-VL-P | artificial | nt | CAGGTGCAGCTGGTCCAGTCTGGGGCTGAGGTGAAGAAGCCTCCTG CAAGGCTTCTGGGTACACCTTCACCAACTACTATATACACTGGGTG CGACAAG GTCTTGAGTGGATGGGTTGGATCAACCCTAACAGTGGTGCCACAAACTATGCACAGAAGTTCAG GCAGAGTCACCATGACCAGGGACACGTCTACAGCAGTCTACATGGAGCTGAGCAGCCTGAG ATCTGAGGACACGGCCGTCTATTACTGCGCAAATCCTGGTGGTTGCTCCTCCGGGGTC AAGGAACCTTGGTCACCGTCTCCAGTGGTGGCGGATCCCTGGCTCTGTGTCTCCGGAGAGGGCAC CATCAACTGCAAGTCCAGCCAGAGTGTTTTAAACAGCTCCAACAATAGGAACTACCTGGT ACCAGAGAACCAGGACAGCCTCCTAAGCTGCTCATTTACTGGGCATCTACCCGGAATCGGG GTCCCTGACCAGTGCCAGTTGGTGGCCAGATTTACTCTCCACCATCAGTGGCCTGCA GGCTGAAGATGTGGCAGTTTATTACTGTCAGCAACATTATAGTACTCCTCACTTTTGCCCTG GGACCAAAGTGGATATCAAATCCGGAGGTGTGATCCAAGGTGGAGGTTCAGCTCGAGTGAAGAA GCACCAATGGAACTTTCAAGGAGGGTCATTGAAACTCTCAGAGCTCATCAACTG CTACGCACTGGTCACCGAGTCACCGTCACCTGGTGGGTTGGCCGGCTCCGGTGGTGGT GGACTCTGGGTCACCGTCTCCAGGGTCTGTTATTACTGGAGAACCTTGTAATGCATGGAAGACTCACA TCTGAGCTCTGTGACTGGGCTGTTAATAGGTGGGACTAAGTTCTCACTCGCCACCGCCCAAACCAG TTGGTGCCGCCAGGTCAAAACGGTGCGCCTAGATCCACCCCTGCGAGAGATGGCCATCGGGT GTCAGGCACCCCCGTGCTGCTCTGGAGGCAAGGCTGCCCCTCAGGGTACGCACAGATGCC AGAATATTACTGTCTCTATGGTACAGCACCGTGGGTGTTCGGTGGAGGAACCAAACTGACTG TCCTA |
| 203. | MCSP-G4 VH-VL-P x A2J VH-VL-P | artificial | aa | QVQLVQSGAEVKKPGASMKVSCKASGYTFTNYYIHWVRQAPGQGLEWMGWINPNSGATNYAQKFQ GRVTMTRDTSTSTVYMELSSLRSEDTAVYYCAKSWVSWFASWGQGTLVTVSSGGGGSGGGGSGGGG GSELVMTQSPDSLAVSLGERATINCKSSQSVLNSSNNRNYLAWYQQKPGQPPKLLIYWASTRESG VPDRFSGSGSGTDFTLISLQAEDVAVYYCQQHYSTPFTFGPGTKVDIKSGGGGSEVQLLESGG GLVQPGGSLKLSCAASGFTFNVYAMNWVRQAPGKGLEWVARIRSKYNNYATYYADSVKKRFTISR DDSKNTAYLQMNNLKTEDTAVYYCVRHGNFGNSYLSWAYWGQGTLVTVSSGGGGSGGGGSGGGG SELVVTQEPSLTVSPGGTVLTCRSSTGAVTSGYYPNWVQQKPGQAPRGLIGATDMRPSGTPARF SGSLLGGKAALTLSGVQPEDEAEYYCALWYSNRWVFGGGTKLTVL |
| 204. | MCSP-G4 VH-VL-P x A2J VH-VL-P | artificial | nt | CAGGTGCAGCTGGTCCAGTCTGGGGCTGAGGTGAAGAAGCCTCCTG CAAGGCTTCTGGGTACACCTTCACCAACTACTATATACACTGGGTG CGACAAG GTCTTGAGTGGATGGGTTGGATCAACCCTAACAGTGGTGCCACAAACTATGCACAGAAGTTCAG GCAGAGTCACCATGACCAGGGACACGTCTACAGCAGTCTACATGGAGCTGAGCAGCCTGAG ATCTGAGGACACGGCCGTCTATTACTGCGCAAATCCTGGTGGTTGCTCCTCCGGGGTC AAGGAACCTTGGTCACCGTCTCCAGTGGTGGCGGATCCCTGGCTCTGTGTCTCCGGAGAGGGCAC CATCAACTGCAAGTCCAGCCAGAGTGTTTTAAACAGCTCCAACAATAGGAACTACCTGGT ACCAGAGAACCAGGACAGCCTCCTAAGCTGCTCATTTACTGGGCATCTACCCGGAATCGGG GTCCCTGACCAGTTCAGTGCCAGTTGGTGGCAGATTTCACTCTCACCATCAGTGGCCTGCA GGCTGAAGATGTGGCAGTTTATTACTGTCAGCAACATTATAGTACTCCTCACTTTTGCCCTG GGACCAAAGTGGATATCAAATCCGGAGGTGTGATCCAAGGTGGAGGTTCAGCTCGAGTTCAAGGA GGATTGGTGCAGCCTGGGGATCCCTGAAACTCTCCTGTGCAGCCTCTGGATTCACCTTCAATGT |

| SEQ ID NO. | DESIGNATION | SOURCE | TYPE | SEQUENCE |
|---|---|---|---|---|
| | | | | CTACGCCATGAACTGGGTCCGCCAGGCTCCAGGAAAGGGTTTGAATGGGTTGCTCGCATAAGAA |
| | | | | GTAAATATAATGATGCAACATATTATCCGGAATATGCTGAATGCAGTTCAGTGAAAAGAGAGTTCACCATTCCAGA |
| | | | | GATGATTCAAAAAACACTGCCTATCTACAACATTTCGGTAATAGCTACTTATCCTGGTGGCACACTGCCGTGTA |
| | | | | CTACTGTGTTGAGACATGGAACTTCTCAGCTGGTGGTGGTTCTGGCGGCGGCGGCTCCGGTGGTGGTGGT |
| | | | | GGACTCTGGTCACCGTCTCCAGCTGGTTCTGGCGGCGGCGGCTCCGGTGGTGGTGGTGGTGGT |
| | | | | TCTGAGCTCGTTGTGACTCAGGAGCCTTCACTCTGCTGTACATCTGCCTACTCACCGTACCGTATCACCTGGTGACAGTCACTCAC |
| | | | | TTGTCCTCCTGCACCCGTGTCTATGAGTGCCACTGACATGAGGCCTCTCAGGGTCAGCCAGGATGAGGC |
| | | | | TCAGGCACCCCGTCTGCTTGAAGCAAGGCTGCCCTTCACCCCTCAGGGTACAGCCAGGATGAGGC |
| | | | | AGAATATTACTGTCTCTATGGTACAGCACCGCTGGGTGTTCGGTGGAGGAACCAAACTGACTG |
| | | | | TCCTA |
| 205. | MCSP-G4 VH-VL-P x E1L VH-VL-P | artificial | aa | QVQLVQSGAEVKRPGASMKVSCKASGYTFTNYYIHWVRQAPGQGLEWMGWINPNSGATNYAQKFQ |
| | | | | GRVTMTRDTSTSTVYMELSLRSEDTAVYYCAKSWVSWFASWGQGTLVTVSSGGGGSGGGGSGG |
| | | | | GSELVMTQSPDSLAVSLGERATINCKSSQSVLNSSNNRNYLAWYQQKPGQPPKLLIYWASTRESG |
| | | | | VPDRFSGSGSGTDFTLTISGLQAEDVAVYYCQQHYSTPFTFGPGTKVDIKSGGGGSEVQLLESGG |
| | | | | GLVQPGGSLKLSCAASGFTFNKYAMNWVRQAPGKGLEWVARIRSKYNNYATYYADSVKSRFTISR |
| | | | | DDSKNTAYLQMNNLKTEDTAVYYCVRHGNFGNSYTSYAYWGQGTLVTVSSGGGGSGGGGS |
| | | | | SELVVTQEPSLTVSPGGTVTLTCGSSTGAVTSGYYPNWVQQKPGQAPRGLIGGTKFLAPGTPARF |
| | | | | SGSLLGGKAALTLSGVQPEDEAEYYCALWYSNRWVFGGGTKLTVL |
| 206. | MCSP-G4 VH-VL-P x E1L VH-VL-P | artificial | nt | CAGGTGCAGCTGGTCCAGTCTGGGGCTGAGGTGAAGAGGCCTGGGGCCTCAATGAAGGTCTCCTG |
| | | | | CAAGGCTTCTGAGTGACATGGGTTGGATCAACCTAACAGTGGTGCCACAAACTATGCACAGAGTTCAG |
| | | | | GGCAGAGTCACCATGACCAGGGACACGTCCACGAGCACAGTCTACATGGAGCTGAGCAGCCTGAG |
| | | | | ATCTGAGGACACGGCCGTGTATTACTGTGCGAAATCTGGTGGTTTCGGTTGCTTCCTGGGTC |
| | | | | AAGGAACCTTGGTCACCGTCTCCAGGTGGTGGTGCTCAGGATGACCCCAGTGTCTGCCAGAGTGTCTGGCG |
| | | | | GGTTCTGAGCTCGTGATGACCCAGAGTGTTTAAACAGCTCCAACAATAGAACTACTTAGCTTGGT |
| | | | | ACCAGCAGAAACCAGGACAGCCTCCTAAGCTGCTCATTCATTGGGCCAGCATCCGGGAATCCGGG |
| | | | | GTCCCTGACCGATTCAGTGGCAGTGGTTATTCGTCAGGACAGATTTACTCTCACCATCAGTGCCTGCA |
| | | | | GGCTGAAGATGTGGCAGTTTATTACTGCCAGCAACATTAGTACTCCATTCACTTTTGGCCCTG |
| | | | | GGACCAAAGTGGATATCAAATCCGGAGGTGTGATCCGAGGTGCAGCTGTTGGAGTCTGGAGGA |
| | | | | GGATTGGTCAGCCTGAGACTCTCATGTGCAGCCTCTGGATTCACCTTCAATAA |
| | | | | GTACGCCATGAACTGGGTCCGCCAGGCTCCAGGAAAGGGTTTGAATGGGTTGCTCGCATAAGAA |
| | | | | GTAAATATAATGATGCAACATATTATCCGGAATATGCTGAATGCAGTTCAGTGAAAAGAGAGTTCACCATTCCAGA |
| | | | | GATGATTCAAAAAACACTGCCTATCTACAACATTTCGGTAATAGCTACTTATCCTGGTGGCACACTGCCGTGTA |
| | | | | CTACTGTGTTGAGACATGGAACTTCTCAGCTGGTGGTGGTTCTGGCGGCGGCGGCTCCGGTGGTGGTGGT |
| | | | | GGACTCTGGTCACCGTCTCCAGCTGGTTCTGGCGGCGGCGGCTCCGGTGGTGGTGGTGGTGGT |
| | | | | TCTGAGCTCGTTGTGACTCAGGAGCCTTCACTCTGCTGTACATCTGCCTACTCACCGTACCGTATCACCTGGTGACAGTCACTCAC |
| | | | | TTGTGGCTCCTGCACCCGTGTCTATGAGTGCCACTGACATGAGGCCTCTCAGGGTCAGCCAGGATGAGGC |
| | | | | TCAGGCACCCCCGTCTGCTTGAAGCAAGGCTGCCCTCACCCCTCAGGGTACAGCCAGGATGAGGC |
| | | | | AGAATATTACTGTCTCTATGGTACAGCACCGCTGGGTGTTCGGTGGAGGAACCAAACTGACTG |
| | | | | TCCTA |
| 207. | MCSP-G4 VH-VL-P x E2M VH-VL-P | artificial | aa | QVQLVQSGAEVKRPGASMKVSCKASGYTFTNYYIHWVRQAPGQGLEWMGWINPNSGATNYAQKFQ |
| | | | | GRVTMTRDTSTSTVVMELSLRSEDTAVYYCAKSWVSWFASWGQGTLVTVSSGGGGSGGGGSGG |
| | | | | GSELVMTQSPDSLAVSLGERATINCKSSQSVLNSSNNRNYLAWYQQKPGQPPKLLIYWASTRESG |
| | | | | VPDRFSGSGSGTDFTLTISGLQAEDVAVYYCQQHYSTPFTFGPGTKVDIKSGGGGSEVQLLESGG |
| | | | | GLVQPGGSLKLSCAASGFTFNGYAMNWVRQAPGKGLEWVARIRSKYNNYATYYADSVKERFTISR |

| SEQ ID NO. | DESIGNATION | SOURCE | TYPE | SEQUENCE |
|---|---|---|---|---|
| | | | | DDSKNTAYLQMNNLKTEDTAVYYCVRHRNFGNSYLSWFAYWGQGTLVTVSSGGGGSGGGGSGGGG SELVVTQEPSLTVSPGGTVTLTCRSSTGAVTSGYYPNWVQQKPGQAPRGLIGATDMRPSGTPARF SGSLLGGKAALTLSGVQPEDEAEYYCALWYSNRWVFGGGTKLTVL |
| 208. | MCSP-G4 VH-VL-P × E2M VH-VL-P | artificial | nt | CAGGTGCAGCTGGTCCAGTCTGGGGCTGAGGTGAAGAAGCCTGGGGCCTCAGTGAAGGTCTCCTG CAAGGCTTCTGGATACACCTTCACCAACTACTATATACACTGGGTGCGACAGGCCCCTGGACAAG GTCTTGAGTGGATGGGATGGATCAACCCTAACAGTGGTGCCACAAATATGCACAGAAGTTCAG GGCAGAGTCACCATGACCAGGGACACGTCCACGAGCACAGTCTACATGGAGCTGAGCAGCCTGAG ATCTGAGGACACGGCCGTCTATTACTGTGCGAAATCTGGCCTGGTTCCTGGTTTGCTTCCTGGGGTC AAGGAACCCTTGGTCACCGTCTCCTCAGGTGGTGGTGGTTCTGGCGGCGGCGGCTCCGGTGGTGGT GGTTCTGAGCTGCAAGTCGTGATGACCCAGAGTCCTTTAAACAGCTCCAACATAGGAACTTAGCTTGGT CATCAACTGCAAGTGCAGCCAGCAGCCTGCTCATTTACTGCCAATTTACTTCACCGGGCATCCGGG GTCCCTGACCGATCAGTGGCAGCTTGGAGCAAGGGTTGGAATGGGTTGCTGCATAAGAA GCTGAAGATGTGCAGTTTATTACTGTCAGCAACATTATAGTACTCCATTCACTTTTTGGCCCTG GGACCAAAGTGGATATCAATCCGGAGGTGGTGATCCAGGTGCAGCTGCAGTCTGGGGGAGGA CTACGCCATGAACTGGGTCCGCCAGGCTCCAGGGAAGGGTTTGGAATGGTTGCTGCATAAGAA GTAATATATAATGCAAACATTATTATGCGATTCAGTAGAACTTCAGTGAAAGAGAGTTCACCATCTCCAGA GATGATTCAAAAAACACTGCCTATCTACAAATGAACAGTCTGAAAACTTGAGGACACTGCCGTGTA CTACTGTGTGAGACATAGGAACTTCACTTATATCCTGGTTCGCTTACTGGGCCAAG GGACTCTGGTCACCGTCTCCTCAGGTGGTTCTGGCGGCGGCGGCTCCGGTGGTGGTGGTTCTGGT TCTGAGCTCGTGTTGTGACTCAGGGACGTTCTAATAGGTGCCACTGACATGAGGCCCTCTGGTACTCCTGCCAGATTC TTGTCGCCTCCGACTGGGCTGTTACATCTGGCTACATACCGAAGCTGGTCAACAAAAACCAG TCAGGCACCCCCGTGTCTAATAGGTGCCACTGACATGAGGCCCTCTCAGGGTACCCTGAGGATGAGC AGAATATTACTGTCTCTATGGTACAGCAACCGCTGGGTTCGTGAGGAACCAAACTGACTG TCCTA |
| 209. | MCSP-G4 VH-VL-P × F70 VH-VL-P | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWVSWFASWGQGTLVTVSSGGGGSGGGGSGGGG GSELVMTQSPDSLAVSLGERATINCKSSQSVLNSSNNRNYLAWYQQKPGQPPKLLIYWASTRESG VPDRFSGSGSGTDFTLTISGLQAEDVAVYYCQQHYSTPFTFGPGTKVDIKSGGGGSEVQLLESGG GLVQPGGSLKLSCAASGFTFNVYAMNWVRQAPGKGLEWVARIRSKYNNYATYYADSVKKRFTISR DDSKNTAYLQMNNLKTEDTAVYYCVRHGNFGNSYISWAYWGQGTLVTVSSGGGGSGGGGSGGGG SELVVTQEPSLTVSPGGTVTLTCGSSTGAVTSGYYPNWVQQKPGQAPRGLIGTKFLAPGTPARF SGSLLGGKAALTLSGVQPEDEAEYYCALWYSNRWVFGGGTKLTVL |
| 210. | MCSP-G4 VH-VL-P × F70 VH-VL-P | artificial | nt | CAGGTGCAGCTGGTCCAGTCTGGGGCTGAGGTGAAGAAGCCTGGGGCCTCAGTGAAGGTCTCCTG CAAGGCTTCTGGATACACCTTCACCAACTACTATATACACTGGGTGCGACAGGCCCCTGGACAAG GTCTTGAGTGGATGGGATGGATCAACCCTAACAGTGGTGCCACAAATATGCACAGAAGTTCAG GGCAGAGTCACCATGACCAGGGACACGTCCACGAGCACAGTCTACATGGAGCTGAGCAGCCTGAG ATCTGAGGACACGGCCGTCTATTACTGTGCGAAATCTGGCCTGGTTCCTGGTTTGCTTCCTGGGGTC AAGGAACCCTTGGTCACCGTCTCCTCAGGTGGTGGTGGTTCTGGCGGCGGCGGCTCCGGTGGTGGT GGTTCTGAGCTGGTGATGACCCAGAGTCCTGATTCACTTGCTGTCTCTGGGCGAGGGCCAC CATCAACTGCAAGTCCAGCCAGAGTGTTTTAAACAGCTCCAACATAGGAACTTAGCTTGGT ACCAGCAGAAACCAGGACAGCCTCCTAAGCTGCTCATTTACTGGCATCTACCCGGGAATCCGGG GTCCCTGACCGATTCAGTGGCAGCGGGTCTGGGACAGATTTCACTCTCACCATCAGTGGCCTGCA GGCTGAAGATGTGGCAGTTTATTACTGTCAGCAGGACAACATTATAGTACTCCATTCACTTTTGGCCCTG GGACCAAAGTGGATATCAAATCCGGAGGTGGTGGATCCGAGGTGCAGCTGCTCGAGTCTGGAGGA GGATTGGTGCAGCCTGGAGGGTCATTGAAACTCTCATGTGCAGCCTCTGGATTCACCTTCAATGT |

-continued

| SEQ ID NO. | DESIGNATION | SOURCE | TYPE | SEQUENCE |
|---|---|---|---|---|
| | | | | GTACGCGCCATGAACTGGGTCCGCCAGGCTCCGGGAAGGGTTTGGAATGGGTTGCTCGCATAAGAA |
| | | | | GTAAATATAATAAACAAAAACACTGCCTATCTACAACATTCAGTGAGAAAAGAGTTGAAGAAGA |
| | | | | GATGATTCAAAAAACACTGCCTATCTACAACATTCAGTGAGAACTGAAGACACTGCCGTGTA |
| | | | | CTACTGTGTGAGACATGGAAATCTTCGGTAATAGCTACTACATATCCTGGTGGGCTTACTGGGGTCAA |
| | | | | GGACTCTGGTCTCAGTGTTTCTGCAGCTGTGGTCATCTGCCACCTGGTGCTCCGGTGTGGTGT |
| | | | | TCTGAGCTCGTTGTGACTGGGCTGTTAATCTGGACTAAGTTCTCACCTCTGGAACAGTCACTCAC |
| | | | | TTGTGCTCCTCGACCTGTGTCTATAGGTGGACTAAGTTCTCCGCCCCGGTACTCCTGCCAGATTC |
| | | | | GTCAGGCACCCCGTGTCTATAGGTGGACTAAGTTCTCCGCCCCGGTACTCCTGCCAGATTC |
| | | | | TCAGGCTCCCTGCTTGAGGCAAGGCTGCCTCCCTGCCTCCAGGGGTTCGGTGAGGAACAAACTGACTG |
| | | | | AGAATATTACTGTGCTCTATGGTACAGCACCGCTGGGTTCCGTGGAGGAACCAAACTGACTG |
| | | | | TCCTA |
| 211. | MCSP-G4 VH-VL-P x F12Q VH-VL | artificial | aa | QVQLVQSGAEVKRPGASMKVSCKASGYTFTNYYIHWVRQAPGQGLEWMGWINPNSGATNYAQKFQ |
| | | | | GRVTMTRDTSTSTVYMELSSLRSEDTAVYYCAKSWVSWFASWGQGTLVTVSSGGGSGGGSGG |
| | | | | GSELVMTQSPDSLAVSLGERATINCKSSQSVLNSSNNRNYLAWYQQKPGQPPKLLIYWASTRESG |
| | | | | VPDRFSGSGSGTDFTLTISGLQAEDVAVYYCQQHYSTPFTFGPGTKVDIKSGGGGSEVQLVESGG |
| | | | | GLVQPGGSLKLSCAASGFTFNSYAMNWVRQAPGKGLEWVARIRSKYNNYATYYADSVKGRFTISR |
| | | | | DDSKNTAYLQMNNLKTEDTAVYYCVRHGNFGNSYVSWNAYWGQGTLVTVSSGGGSGGGGSGG |
| | | | | SQTVVTQEPSLTVSPGGTVTLTCGSSTGAVTSGNYPNWVQQKPGQAPRGLIGGTKFLAPGTPARF |
| | | | | SGSLLGGKAALTLSGVQPEDEAEYYCVLWYSNRWVFGGGTKLTVL |
| 212. | MCSP-G4 VH-VL-P x F12Q VH-VL | artificial | nt | CAGGTGCAGCTGGTCCAGTCTGGGGCTGAGGTGAAGAGGCCTGGGGCCTCAGTGAAGGTCTCCTG |
| | | | | CAAGGCTTCTGAGTGACCTGGGGCTACACCTTCACCAACTACTATATACACTGGGTGCGACAG |
| | | | | GTCTTGAGTGGATGGGTTGGATCAACCCTAACAGTGGTGCCACAAACTATGCACAGAAGTTCAG |
| | | | | GGCAGAGTGCACCATGACCAGGGACACGTCCACGAGCACAGTCTACATGGAGCTGAGCAGCCTGAG |
| | | | | ATCTGAGGACACGGCCGTCTATTACTGTGCGAAATCTGGTTCCTGGTTTGCTTCCTGGGGTC |
| | | | | AAGGAACCCTTGGTCACCGTCTCAGGTGGTGGTCCCAGACTCTCCCAGGTGTGCTCTGGCGAGGGGCAC |
| | | | | GGTTCTGAGCTCGTGATGACCCAGAGTTTAAACAGCTGCAACAATAGGAACATTAACTTAGCTTGGT |
| | | | | ACCAGCAGAAACCAGGACAGCCTCCTAAGCTGCTCATTTACTGGGCATCTACCCGGGAATCCGGG |
| | | | | GTCCCTGACCGATTCAGTGGCAGCGGGTCTGGGACAGATTTCACTCTCACCATCAGTGGCCTGCA |
| | | | | GGCTGAAGATGTGCAGTTTATACTGTCAGCAACATTATAGCTACTCCATTCACTTTTGGCCCTG |
| | | | | GGACCAAAGTGGATATCAAATCCGGAGGTGGTGATCCGAGGTGCAGCTGGTCGAGTCTGGAGGA |
| | | | | GGATTGGTGCAGCCTGGAGGGTCATTGAAACTTCATGTGCAGCTCTGGATTCACCTTCAATAG |
| | | | | CTACGCCATGAACTGGGTCCGCCAGGCTCCAGGGAAGGGTTTGGAATGGGTTGCTCGCATAAGAAG |
| | | | | GTAAATATAATAAACAAAAACACTGCCTATCTACAACATTCAGTGAGAAAAGAGTTGAAGAAGA |
| | | | | GATGATTCAAAAAACACTGCCTATCTACAACATTCAGTGAGAACTGAAGACACTGCCGTGTA |
| | | | | CTACTGTGTGAGACATGGAAATCTTCGGTAATAGCTACTACATATCCTGGTGGGCTTACTGGGGTCAA |
| | | | | GGACTCTGGTCTCAGTGTTTCTGCAGCTGTGGTCATCTGCCACCTGGTGCTCCGGTGTGGTGT |
| | | | | TCTCAGACTGTGTTGACTGGGCTGTTAATCTGGACTAAGTTCTCACCTCTGGAACAGTCACTCAC |
| | | | | TTGTGCTCCTCGACCTGTGTCTATAGGTGGACTAAGTTCTCCGCCCCGGTACTCCTGCCAGATTC |
| | | | | GTCAGGCACCCCGTGTCTATAGGTGGACTAAGTTCTCCGCCCCGGTACTCCTGCCAGATTC |
| | | | | TCAGGCTCCCTGCTTGAGGCAAGGCTGCCTCCCTGCCTCCAGGGGTTCGGTGAGGAACAAACTGACTG |
| | | | | AGAATATTACTGTGCTCTATGGTACAGCACCGCTGGGTTCCGTGGAGGAACCAAACTGACTG |
| | | | | TCCTA |
| 213. | MCSP-G4 VH-VL-P x I2C VH-VL | artificial | aa | QVQLVQSGAEVKRPGASMKVSCKASGYTFTNYYIHWVRQAPGQGLEWMGWINPNSGATNYAQKFQ |
| | | | | GRVTMTRDTSTSTVYMELSSLRSEDTAVYYCAKSWVSWFASWGQGTLVTVSSGGGSGGGSGG |
| | | | | GSELVMTQSPDSLAVSLGERATINCKSSQSVLNSSNNRNYLAWYQQKPGQPPKLLIYWASTRESG |
| | | | | VPDRFSGSGSGTDFTLTISGLQAEDVAVYYCQQHYSTPFTFGPGTKVDIKSGGGGSEVQLVESGG |
| | | | | GLVQPGGSLKLSCAASGFTFNKYAMNWVRQAPGKGLEWVARIRSKYNNYATYYADSVKDRFTISR |

-continued

| SEQ ID NO. | DESIGNATION | SOURCE | TYPE | SEQUENCE |
|---|---|---|---|---|
| 214. | MCSP-G4 VH-VL-P x I2C VH-VL | artificial | nt | CAGGTGCAGCTGGTCCAGTCTGGGGCTGAGGTGAAGAAGCCTGGGGCCTCAGTGAAGGTCTCCTG<br>CAAGGCTTCTGGATACACCTTCACCGGCTACTACATGCACTGGGTGCGACAGGCCCCTGGACAAG<br>GTCTTGAGTGGATGGGATCAACCTAACAGTGGTGGCACAAACTATGCACAGAAGTTCCAG<br>GGCAGAGTCACCATGACCAGGGACACGTCCACGAGCACAGTCTACATGGAGCTGAGCAGCCTGAG<br>ATCTGAGGACACGGCCGTCTATTACTGTGCGAAATCTGACTTTGGTCCTTGCTCCGGGGTC<br>AAGGAACCTTGGTCACCGTCTCCTCAGGTGGTGGTGGTTCGGCGGGCGGCGGCTCGGGTGGT<br>GGTTCTGAGCTCGTGATGACCCAGAGTCCTTTAAACAGCTCCAACATTACAGTCTAGCTTGGT<br>CATCAACTGCAAGTCCAGCCAGAGCCTCCTAGCTGCTCATTACTGCTCCACCATCAGTGGCTGCA<br>GTCCCTGACCAGTGCGACAGATTTCACTCTCACCATCAGTGCCTGCA<br>GGCTGAAGATGTGCAGTTTATTACTGTCAGCAACATTATAGTACTCCTCACTTTTGGCCTG<br>GGACCAAAGTGGATATCAAATCCGGAGGTGTGATCAGCCTCCAGCTGGTCGAGTCTGGAGGA<br>GGATTGGTGCAGCCTGGAGGGTCATTGAAACTCTCATGTGCAGCTTCTGGATTCACCTTCAATAA<br>GTACGCCATGAACTGGGTCCGCCAGGCTCCAGGAAAGGGTTTGAATGGGTTCTGCATAAGAA<br>GTAAATATAATAAATTATGCAACATATATTATCCGATTCAGTGAAGACACAGTTCACCATCTCCAGA<br>GATGATTCAAAAAACACTGCCTATCTACAAATGAACACTTGAAAACTGAGGACACTGCTGTTATTG<br>CTACTGTGTGAGACATGGACATTCGGTAAATAGCTACTACTTCACTGGTTACTGGGGCCAAG<br>GGACTCTGGTCACCGTCTCCTCAGGTGGTGGTGGTTCGGCGGCGGCGGCTCCGGTGGTGGTGGT<br>TCTCAGACTGTTGTGACTCAGGGGCTGTTACATCTGGACCTACCCCAACAGTCACACTCAC<br>TTGTGCTCTCGACTGGGTCTTAATAGGTGGAAGTTCCCTTTCATCTAGAAATTCCTGCCAGATTC<br>TCAGGCTCCCCCTGTCCCTGGGCAAGGCTCCTCTCAGGGTACGCAGGATGGAGC<br>AGAATATTACTGTGTCTATGGTACAGCACCGCTGGGTTCGTGGTGGAGGAACCAAACTGACTG<br>TCCTA |
| 215. | MCSP-D2 VH-VL x H2C VH-VL | artificial | aa | QVQLVQSGAEVKKPGASVKVSCKASGYTFTGYYMHWVRQAPGQGLEWMGWINPNSGGTSYAQKFQ<br>GRVTMTRDTSTSTVYMELSSNLRSDDTAVYYCAKSMVSWFASWGQQTLVTVSSGGGGSGGGGSGGG<br>GSDIVMTQSPDSLAVSLGERATINCKSSQSVLNSSNNRNYLAWYQQKPGQPPKLLIYWASTRESG<br>VPDRFSGSGSGTDFTLTISGLQAEDVAVYYCQQHYSTPFTFGPGTKVDIKSGGGGSEVQLVESGG<br>GLVQPGGSLKLSCAASGFTFNKYAMNWVRQAPGKGLEWVARIRSKYNNYATYYADSVKDRFTISR<br>DDSKNTAYLQMNNLKTEDTAVYYCVRHGNFGNSYISYWAYWGQGTLVTVSSGGGGSGGGGSGGGG<br>SQTVVTQEPSLTVSPGGTVTLTCGSSTGAVTSGNYPNWVQQKPGQAPRGLIGGTKFLAPGTPARF<br>SGSLLGGKAALTLSGVQPEDEAEYYCALWYSNRWVFGGGTKLTVL |
| 216. | MCSP-D2 VH-VL x H2C VH-VL | artificial | nt | CAGGTGCAGCTGGTCCAGTCTGGGGCTGAGGTGAAGAAGCCTGGGGCCTCAGTGAAGGTCTCCTG<br>CAAGGCTTCTGGATACACCTTCACCGGCTACTACATGCACTGGGTGCGACAGGCCCCTGGACAAG<br>GGCTTGAGTGGATGGGATGGATCAACCCTAACAGTGGTGGCACAAGCTACGCACAGAAGTTCCAG<br>GGCAGAGTCACCATGACCAGGGACACGTCCACGAGCACAGTCTACATGGAGCTGAGCAACCTGAG<br>ATCTGACGACACGGCCGTCTATTACTGTGCGAAATCCTGGTTGCTTCTGGTTTGCTTCCGGGGTC<br>AAGGAACCTTGGTCACCGTCTCCTCAGGTGGTGGTTCGGCGGCGGCGGCTCCGGTGGTGGT<br>GGTTCTGATATCGTGATGACCCAGAGTCCAGACTCCTTGGCTGTGTCTCTGGGCGAGAGGGCCAC<br>CATCAACTGCAAGTCCAGCCAGAGCGTCCTCAACAGCTCCAACAATAGAACTTAGCTTGGT<br>ACCAGCAGAAACCAGGACAGCCTCCTAAGCTGCTCATTTACTGGGCATCTACCCGGAATCCGG<br>GTCCCTGACCGATTCAGTGGCAGCGGGTCTGGGACAGATTTCACTCTCACTATCAGTGGCCTGCA<br>GGCTGAAGATGTGGCAGTTTATTACTGTCAGCAACATTATAGTACTCCATTCACTTTTGGCCCTG<br>GGACCAAAGTGGATATCAAATCCGGAGGTGTGGATCAGCCTCCAGCTCGTGGAGTCTGGAGGA<br>GGATTGGTGCAGCCTGGAGGGTCATTGAAACTCTCATGTGCAGCCTCTGGATTCACCTTCAATAA |

-continued

| SEQ ID NO. | DESIGNATION | SOURCE | TYPE | SEQUENCE |
|---|---|---|---|---|
| | | | | GTACGCCATGAACTGGGTCCGCCAGGCTCCAGGAAAGGGTTTGAATGGGTTGCTCGCATAAGAA<br>GTAAATATAATAATCAAAAACACTGCCTATCTACAAATGAACAGTTCAGTGAAGACAGTTCACCATTCCAGA<br>GATGATTCAAAAACACTGCCTATCTACAACTTGGTAATAGCTACAATATCCTACTGGGCTCAAG<br>GGACTCTGGTGTCACCGTCTCCAGGTGCTTCTGGCGCGGTCCTCGGTGGTGGTGT<br>TCTCAGACTGTTGTGACTGGGCTGTTACATCTGGACTAAGTTCTCACCGTATCACCTGGAACAGTCACTCAC<br>TTGTGCTCCTCGACCCCGTGGTCTAATAGGTGGGACTAAGTTCTCGCCCCGTACTCCTGCCAGATTC<br>GTCAGGCACCCCGTGCTCCTGGAGGCAAGGCTGCCCTCAGGGTACAGCCAGAGATGAGGC<br>AGAATATTACTGTCTCTATGGTACAGACCGCTGGGTGTTCGTGGAGGAACCAAACTGACTG<br>TCCTA |
| 217. | MCSP-D2 VH-VL x<br>F12Q VH-VL | artificial | aa | QVQLVQSGAEVKKPGASVKVSCKASGYTFTGYYMHWVRQAPGQGLEWMGWINPNSGGTSYAQKFQ<br>GRVTMTRDTSTSTVYMELSNLRSDDTAVYYCAKSWVSWFASWGQGTLVTVSSGGGGSGGGGSGGGG<br>GSDIVMTQSPDSLAVSLGERATINCKSSQSVLNSSNNRNYLAWYQQKPGQPPKLLIYWASTRESG<br>VPDRFSGSGSGTDFTLTISGLQAEDVAVYYCQQHYSTPFTFGPGTKVDIKSGGGGSEVQLVESGG<br>GLVQPGGSLKLSCAASGFTFNSYAMNWVRQAPGKGLEWVARIRSKYNNYATYYADSVKGRFTISR<br>DDSKNTAYLQMNNLKTEDTAVYYCVRHGNFGNSYVSWAYWGQGTLVTVSSGGGGSGGGGSGGGG<br>SQTVVTQEPSLTVSPGGTVTLTCGSSTGAVTSGNYPNWVQQKPGQAPRGLIGGTKFLAPGTPARF<br>SGSLLGGKAALTLSGVQPEDEAEYYCVLWYSNRWVFGGGTKLTVL |
| 218. | MCSP-D2 VH-VL x<br>F12Q VH-VL | artificial | nt | CAGGTGCAGCTGGTCCAGTCTGGGGCTGAGGTGAAGAAGCCTGGGGCCTCAGTGAAGGTCTCCTG<br>CAAGGCTTCTGGATACACCTTCACCGGCTACTATATGCACTGGGTGCGACAGGCCCCTGGACAAG<br>GGCTTGAGTGGATGGGATGGATCAACCCTAACAGTGGTGCACAGTCTACGAGCAGAAGTTCCAG<br>GGCAGAGTCACCATGACCAGGGACACGTCCACGAGCACAGTCTACATGGAGCTGAGCAGCCTGAG<br>ATCTGACGACACGGCCGTGTATTACTGTGCGAAATCTGGGTTCGTTCCGGTTGCTTCCTGGGGTC<br>AAGGAACCCTGGTCACCGTCTCCAGGTGGTGGTTCTGGCGGCGGCGGCTCCGGTGGTGGT<br>GGTTCTGATATCGTGATGACCCAGAGTCCAGACAGCCTCCAGGTGTTTTAAACAGCTGCTCATTTACTGGGCATCTACCCGGAATCCAGG<br>CATCAACTGCAAGTCCAGCCAGAGCAGTCCTGAACAATAGAACTACCTTAGCTTGGT<br>ACCAGCAGAAACCAGGACAGCCTCCTAAGCTGCTCATTTACTGGGCATCTACCCGGAATCCAGG<br>GTCCCTGACCGATCAGTGCAGCAGGGTCTGGGACAGATTCACTCTCACCATCAGTGCCCTGCA<br>GGCTGAAGATGTGGCAGTTTATTACTGTCAGCAACATTTAGTACTCCTTCACTTTTGGCCCTG<br>GGACCAAAGTGGATATCAAATCCGGAGGTGGTGATCCGAGGTGCAGCTGGTCGAGTCTGGAAGGA<br>GGATTGGTCCAGCCTGGAGGTCATTGAAACTCTCATGTGCAGCCTCTGGATTCACCTTCACCAG<br>CTACGCCATGAACTGGGTCCGCCAGGCTCCAGGAAAGGGTTTGAATGGGTTGCTCGCATAAGAA<br>GTAAATATAATAATCAAAAACACTGCCTATCTACAACTTGGTAATAGCTACAATATCCTACTGGGCTCAAG<br>GATGATTCAAAAACACTGCCTATCTACAACTTGGTAATAGCTACAATATCCTACTGGGCTCAAG<br>GGACTCTGGTGTCACCGTCTCCTCAGGTGGTGGTTCTGGCGGCGGCGGCTCCGGTGGTGGT<br>TCTCAGACTGTTGTGACTCAGGAACCTTCACTCTGTACATCTGGACTCTCCACCGTATCACCTGGAACAGTCACTCAC<br>TTGTGCTCCTCGACCCCGTGGTCTAATAGGTGGGACTAAGTTCTCGCCCCGTACTCCTGCCAGATTC<br>GTCAGGCACCCCGTGCTCCTGGAGGCAAGGCTGCCCTCAGGGTACAGCCAGAGATGAGGC<br>AGAATATTACTGTCTCTATGGTACAGACCGCTGGGTGTTCGTGGAGGAACCAAACTGACTG<br>TCCTA |
| 219. | MCSP-D2 VH-VL x<br>I2C VH-VL | artificial | aa | QVQLVQSGAEVKKPGASVKVSCKASGYTFTGYYMHWVRQAPGQGLEWMGWINPNSGGTSYAQKFQ<br>GRVTMTRDTSTSTVYMELSNLRSDDTAVYYCAKSWVSWFASWGQGTLVTVSSGGGGSGGGGSGGGG<br>GSDIVMTQSPDSLAVSLGERATINCKSSQSVLNSSNNRNYLAWYQQKPGQPPKLLIYWASTRESG<br>VPDRFSGSGSGTDFTLTISGLQAEDVAVYYCQQHYSTPFTFGPGTKVDIKSGGGGSEVQLVESGG<br>GLVQPGGSLKLSCAASGFTFNKYAMNWVRQAPGKGLEWVARIRSKYNNYATYYADSVKDRFTISR<br>DDSKNTAYLQMNNLKTEDTAVYYCVRHGNFGNSYISYWAYWGQGTLVTVSSGGGGSGGGGSGGGG |

| SEQ ID NO. | DESIGNATION | SOURCE | TYPE | SEQUENCE |
|---|---|---|---|---|
| | | | | SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 220. | MCSP-D2 VH-VL x I2C VH-VL | artificial | nt | CAGGTGCAGCTGGTCCAGTCTGGGGCTGAGGTGAAGAAGCCTGGGGCCTCAGTGAAGGTCTCCTG CAAGGCTTCTGGATACACCTTCACCGGCTACTATATGCACTGGGTGCGACAGGCCCCTGGACAAG GGCTTGAGTGGATGGGATGGATCAACCCTAACAGTGGTGCACAGTCACGACAGAAGTTCCAG GGCAGAGTGACCATGACTAGGGACACGTCCACGAGCACAGTCTACATGGAGCTGAGCAGCCTGAG ATCTGACGACACGGCCGTGTATTACTGCGCAAATCCTGGGTCTCCTGGTTTGCTTCCTGGGGTC AAGGAACCTTGGTCACCGTCTCCTCAGGTGGTGGTGGTTCAGGCGGAGGTGGCTCCGGCGGTGGT GGTTCTGATATCGTGATGACCCAGTCTCCAGACTCCTCGTGTCTCTGGGCAGACAGAGGCCAC CATCAACTGCAAGTCCAGCCAGAGTGTTTTAAACAGCTCCAACAATAGGAACTACTTAGCTTGT ACCAGCAGAAACCAGGACAGCCTCCTAAGCTGCTCATTTACTGGGCATCTACCCGGGAATCCGGG GTCCCTGACCGATTCAGTGGCAGCGGGTCTGGGACAGATTTCACTCTCACCATCAGTGCCTGCA GGCTGAAGATGTGGCAGTTTATTACTGTCAGCAATATTAGTAGTACTCCATTCACTTTTGCCTG GGACCAAAGTGGATATCAAATCCGAGGTGTGGATCTCATGTGCAGCCTCTGGATTCACCTTCAGA GGATTGGTGCAGCCTGGAGGGTCCAGGCTCAGGCATTCCCAGGAAAGGGTTTGAATGGGTTGCTCGCATAAGAA GTACGCCATGAACTGGGTCCGCCAGGCTCCAGGGAAGGGGCTGGAGTGGGTTTCAGGTATTAGA TCTAAATAAAATAATATATGCACAACATATTATGCAGACTCCGTGAAAGGCAGGTTCACCATCTCCAGA GATGATTCAAAAAACACTGCCTATCTGCAAATGAACAACTTGAAAACTGAGGACACTGCCGTGTA CTACTGTGTGAGACATGGAACTCTCGGTAATAGCTACTACATATTCTACTGGGCTTACTGGGCCAAG GGACTCTGGTCACCGTCTCCTCAGGTGGTGGTGGTTCTGGCGGCGGCGGCTCCGGTGGTGGTGGT TCTCAGACTGTGTGACTCAGGAACCTTCACTCCACTGTCTCCACCTATCACCTGGCAACTACCACCACACTCAC TTGTGCTCTCGACTGGGCGTGTTAATAGGTGGGACTAAGTTCTCTGCCAACTGGTCCAACAAAACCAG GTCAGGCACCCGGTCCTGCTTGGAGGCAAGGCTGCCCTCACCCTCACGTGGCTACAGCCAGAGGATGAGC TCAGGCTATTACTGTGTCTATGGTACAGCACCAACCGCTGGGGTTCGGTGGAGGAACCAAACTGACTG TCCTA |
| 221. | MCSP-D2 VH-VL-P x H2C VH-VL-P | artificial | aa | QVQLVQSGAEVKKPGASVKVSCKASGYTFTGYYIMHWVRQAPGQGLEWMGWINPNSGGTSYAQKFQ GRVTMTRDTSTSTVYMELSNLRSDDTAVYYCAKSWSWFASWGQGTLVTVSSGGGGSGGGGSGGG GSELVMTQSPDSLAVSLGERATINCKSSQSVLNSSNNRNYLAWYQQKPGQPPKLLIYWASTRESG VPDRFSGSGSGTDFTLTISGLQAEDVAVYYCQQHYSTPFTFGPGTKVDIKSGGGGSEVQLLESGG GLVQPGGSLKLSCAASGFTFNKYAMNWVRQAPGKGLEWVARIRSKYNNYATYYADSVKDRFTISR DDSKNTAYLQMNNLKTEDTAVYYCVRHGNFGNSYISYWAYWGQGTLVTVSSGGGGSGGGGSGGGG SELVVTQEPSLTVSPGGTVTLTCGSSTGAVTSGYYPNWVQQKPGQAPRGLIGGTKFLAPGTPARF SGSLLGGKAALTLSGVQPEDEAEYYCALWYSNRWVFGGGTKLTVL |
| 222. | MCSP-D2 VH-VL-P x H2C VH-VL-P | artificial | nt | CAGGTGCAGCTGGTCCAGTCTGGGGCTGAGGTGAAGAAGCCTGGGGCCTCAGTGAAGGTCTCCTG CAAGGCTTCTGGATACACCTTCACCGGCTACTATATGCACTGGGTGCGACAGGCCCCTGACAAG GGCTTGAGTGGATGGGATGGATCAACCCTAACAGTGGTGCACAGTCACGACAGAAGTTCCAG GGCAGAGTGACCATGACTAGGGACACGTCCACGAGCACAGTCTACATGGAGCTGAGCAGCCTGAG ATCTGACGACACGGCCGTGTATTACTGCGCAAATCCTGGGTCTCCTGGTTTGCTTCCTGGGGTC AAGGAACCTTGGTCACCGTCTCCTCAGGTGGTGGTGGTTCAGGCGGAGGTGGCTCCGGCGGTGGT GGTTCTGAGCTCGTGATGACCCAGTCTCCAGACTCCTCGTGTCTCTGGGCAGACAGAGGCCAC CATCAACTGCAAGTCCAGCCAGAGTGTTTTAAACAGCTCCAACAATAGGAACTACTTAGCTTGT ACCAGCAGAAACCAGGACAGCCTCCTAAGCTGCTCATTTACTGGGCATCTACCCGGGAATCCGGG GTCCCTGACCGATTCAGTGGCAGCGGGTCTGGGACAGATTTCACTCTCACCATCAGTGCCTGCA GGCTGAAGATGTGGCAGTTTATTACTGTCAGCAACATTATGTCAGCAACATTAGTACTCCATTCACTTTTGCCCTG GGACCAAAGTGGATATCAAATCCGAGGTGCAGCTGTTGGAATCTGGAGGAGGCTTGGTACAGCCTGGGGGGT GGATTGGTGCAGCCTGGAGGGTCCCAGGCTCAGGCATTCCCAGGAAAGGGTTTGAATGGGTTGCTCGCATAAGAA GTACGCCATGAACTGGGTCCGCCAGGCTCCAGGGAAGGGGCTGGAGTGGGTTTGCTCGCATAAGA |

-continued

| SEQ ID NO. | DESIGNATION | SOURCE | TYPE | SEQUENCE |
|---|---|---|---|---|
| | | | | GTAAATATAATAATTATGCAACATATTATGCCGATTCAGTGAAAGACAGGTTCACCATCTCAGA |
| | | | | GATGATTCAAAAAACACTGCCTATCTACAAATGAACAACTGATGAAACTGAAGACACTGCCGTGTA |
| | | | | CTACTGTGTGAGACATGGAACTTCGGTATAGTACATACATATCTCAGGCGGCGGCGGCTCACTG |
| | | | | GGACTCTGGTCACCGTCTCCTCAGGTGGTGTGGTGTTCTGGCGGCGGCGGCTCCGGTGGTGGTGGT |
| | | | | TCTGAGCTCTGTTGACTCAGGAACCTTCACTCACCTGCTGTTCACCTGGTCGAACAGTCACACTCAC |
| | | | | TTGTGGCTCTCGACTGGGCTGTTACATCGGACTGTTACAATCGGCTACTACTGCCAAAAACCAG |
| | | | | GTCAGGCACCCGTGGTCTTGGAGGCAAGGCTGCCCTACCTACCCGCTCGTCAGCCAGAGGATGAGGC |
| | | | | TCAGCTCCTGCTGTGGAAGGCTGCCCTACCTCACCCTCGGGTGTTCGGTGGAGGAACCAAACTGACTG |
| | | | | AGAATATTACTGTCTCTATGGTACAGCAGCCTGGGTTCGGTGGAGGAACCAAACTGACTG |
| | | | | TCCTA |
| 223. | MCSP-F9 VH-VL x H2C VH-VL | artificial | aa | QVQLQESGPGLVKPSETLSLTCVVSGGSISSSNNWSWVRQPPGKGLEWLGTIYNGNTYYNPSLK |
| | | | | SRVTISVDTSKNQFSLRLSSVTAADTAVYYCAKSWSVSWFASWGQGTLVTVSSGGGGSGGGGSGGGG |
| | | | | GSDIVMTQSPDSLAVSLGERATINCKSSQSVLSSSNNKNYLNWYQQKPGQPPKLLIYWASTRESG |
| | | | | VPDRFSGSGSGTDFTLTISSLQAEDVAVYYCQQHYSVPFTFGPGTKVDIKGGGGSEVQLVESGGG |
| | | | | LVQPGGSLKLSCAASGFTFNKYAMNWVRQAPGKGLEWVARIRSKYNNYATYYADSVKDRFTISRD |
| | | | | DSKNTAYLQMNNLKTEDTAVYYCVRHGNFGNSYISYWAYWGQGTIVTVSSGGGGSGGGGSGGGGS |
| | | | | QTVVTQEPSLTVSPGGTVTLTCGSSTGAVTSGYYPNWVQQKPGQAPRGLIGGTKFLAPGTPARFS |
| | | | | GSLLGGKAALTLSGVQPEDEAEYYCALWYSNRWVFGGGTKLTVL |
| 224. | MCSP-F9 VH-VL x H2C VH-VL | artificial | nt | CAGGTGCAGCTGCAAGAGTCTGGCCCAGGACTGGTGAAGCCTTCGGAGACCCTGTCCCTCACCTG |
| | | | | CGTTGTCTCTGGTGGCTCCATCAGCAGTAGTAACTGGTGGAGCTGGGTCCGCCAGCCCCAGGGA |
| | | | | AGGGACTGGAGTGGCTTGGACTATATCTATTATAATGGGAACACCTACTACAACCCGTCCTCAAG |
| | | | | AGTCGAGTCACCATCTCCGTAGACACGTCCAAGAACCAGTTCTCCCTGAGGCTGAGCTCTGTGAC |
| | | | | CGCCGCAGACACGGCCGTGTATTACTGTGCGAAATCCTGGGTCTCGGTTTGCTTCCGTGGGTC |
| | | | | AAGGAACCTTGGTCACCGTCTCCTCAGGTGGTGGTGGTTCTGGCGGCGGCGGCTCCGGTGGTGGT |
| | | | | GGTTCTGATATCGTGATGACACAGTCTCCAGACTCTCTATCCAGCAATAAGAACTACTTAAATTGT |
| | | | | CATCAACTGCAAGTCCAGCCAGCCTGGGCTCCTAAGTTGCTCATTTACTGGGCATCTACCCGGGAATCCGGG |
| | | | | GTCCCTGACCGATTCAGTGGCAGCGGGTCTGGGACAGATTTCACTCTCACCATCAGCAGCCTGCA |
| | | | | GGCTGAAGATGTGGCAGTTTATTACTGTCAGCAACATTATAGTGTTCCATTCACTTTCGGCCCTG |
| | | | | GGACCAAAGTGGATATCAAAGGAGGTGGCTCCGAGGTCCAGCTCCTGGATTCACTTCAATAAGTA |
| | | | | CGCCATGAACTGGGTCCGCCAGGCTCCAGGAAAGGGTTTGGAATGGGTTGCTCGCATAAGAAGTA |
| | | | | AATATAATTATTATGCAACATATTATGCCGATTCAGTGAAAGACAGATTCACCATCTCCAGAGAT |
| | | | | GATTCAAAAAACACTGCCTATCTACAAATGAACAACTTGAAAACTGAAGACACTGCCGTGTACTA |
| | | | | CTGTGTGAGACATGGAAATTCGGGTAATAGCTACATATCGTGGCGGCGGCGGCTCCGGTGGTGGT |
| | | | | GGTTCTTCCACCGTCTGTGACTCAGGAACCTCACTCACCTGCTGTTCACCTGGTGGAACAGTCACTTG |
| | | | | CAGACTGTTGTGACTCAGGAACCTTCACTCACCTGCTGTTCACCTGGTGGAACAGTCACACTTG |
| | | | | TGGCTCCTCGACTGGGCTGTAATAGGTGGACTAAGTTCCTGCCCTCACCCTCAGGGGTACAGCCCAGATTCTCA |
| | | | | AGGACACCCGTGGTCTTGGAGGCAAGGCTGCCCTCACCCTCTCAGGGGTACAGCCAGAGGATGAGGCAGA |
| | | | | GGCTCCTGCTGTGGAAGGCTGCCCTCACCCTCTCAGGGGTACAGCCAGAGGATGAGGCAGA |
| | | | | ATATTACTGTCTCTATGGTACAGCAACCCTGGGTTCGGTGGAGGAACCAAACTGACTGTCC |
| | | | | TA |
| 225. | MCSP-F9 VH-VL-P x H2C VH-VL-P | artificial | aa | EVQLQESGPGLVKPSETLSLTCVVSGGSISSSNNWSWVRQPPGKGLEWLGTIYNGNTYYNPSLK |
| | | | | SRVTISVDTSKNQFSLRLSSVTAADTAVYYCAKSWSVSWFASWGQGTLVTVSSGGGGSGGGGSG |
| | | | | GSELVMTQSPDSLAVSLGERATINCKSSQSVLSSSNNKNYLNWYQQKPGQPPKLLIYWASTRESG |
| | | | | VPDRFSGSGSGTDFTLTISSLQAEDVAVYYCQQHYSVPFTFGPGTKVDIKSGGGGSEVQLLESGG |
| | | | | GLVQPGGSLKLSCAASGFTFNKYAMNWVRQAPGKGLEWVARIRSKYNNYATYYADSVKDRFTISR |
| | | | | DDSKNTAYLQMNNLKTEDTAVYYCVRHGNFGNSYISYWAYWGQGTLVTVSSGGGGSGGGGSGGGG |

-continued

| SEQ ID NO. | DESIGNATION | SOURCE | TYPE | SEQUENCE |
|---|---|---|---|---|
| | | | | SELVVTQEPSLTVSPGGTVTLTCGSSTGAVTSGYYPNWVQQKPGQAPRGLIGGTKFLAPGTPARF SGSLLGGKAALTLSGVQPEDEAEYYCALWYSNRWVFGGGTKLTVL |
| 226. | MCSP-F9 VH-VL-P x H2C VH-VL-P | artificial | nt | GAGGTGCAGCTGCAAGAGTCTGGCCCAGGACTGGTGAAGCCTTCGGAGACCCTGTCCCTCACCTG CGTTGTCTCTGGTGCCATCAGCAGTAGTAACTGGTGGAGCTGGATCCGCCAGCCCCCAGGGA AGGGACTGGAGTGGCTTGGGACTATCTATTATAATGGGAATACCTACTACAACCCGTCCCTCAAG AGTCGAGTCACCATCTCCGTAGACACGTCCAAGAACCAGTTCTCCCTGAGGCTGAGCTCTGTGAC CGCCCAGACACGGCCGTGTATTACTGTGCGAAATCCTGGGTCTCTGGTTTGCTTCCTGGGGTC AAGGAACCTTGGTCACCGTCTCCTCAGGTGGTGGTTCTGGCGGCGGCGGCTCCGGTGGTGGT GGTTCTGAGCTCGTGATGACACAGTCTCCTTATCCAGCTGCTCAAGTTCAGTCTCCAGGGAGGG CATCAACTGCAAGTCCAGCCAGAGTGTCTTATCCAGCTGCTATTACTGGGCATCTACCCGGAATCCGG ACCAGCAGAAACCAGGACAGCCTCCTAAGTTGCTCATTTACTGGACAGATTCACTCTCCACCATCAGCCTGCA GTCCCTGACCGATTCAGTGGCAGTGGGTCTGGGACAGATTTCACTCTCACCATCAGCAGCCTGCA GGCTGAAGATGTGGCAGTTTATTACTGTCAGCAACATTATAGTACCATTCACTTCGGCCCTG GGACCAAAGTGGATATCAAATCCGAGGTGTGCAGGTCAGCTGCTCGAGTCTGGAGGA GGATTGGTGCAGCCTGGAGGGTCATTGAAACTCTATGTGCAGCCTCTGGATTCACCTTCAGTAA GTACCGCATGAACTGGGTCCGCCAGGCTCCAGGAAAGGGTTTGGAATGGTTGCTCATAAAGA GTAAATATAATAATTATGCAACATATATTATGAGTGGGTGAAAGACAGGTTCACCATCTCCAGA GATGATTCAAAAAACACTGCCTATCTACAAATGAACAGCTTGAGAACTGAAAACTGAGGACACTGCCGTGTA CTACTGTGTGAGACATGGAACTTCGGTAATAGCTACTATATCTACTGGGCTTACTGGGCCAAG GGACTCTGGTCACCGTCTCCTCAGGTGGTGGTTCTGGCGGCGGCGGCTCCGGTGGTGGTGGT TCTGAGCTCGTTGTGACTCAGAACCTTCACTTCACCGTATCACCTGGCTATCATCAAAAACCAG TTGTGGCTCTCGACTGGGCTGTTAATAGGTGGACTAAGTTCTCGCCCGTACTCCTGCCAGATTC GTCAGGCACCCCTGTCTTGGAGGCAAGGCTGCCCTCACCCTCTCAGGGGTACTCAGCCAGAGGATGAGGC TCAGCTTCTCTATGGTACAGCACCCTGGTGTTCGTGGAGGAACCAACTGACTG AGAATATTACTGTCTCTATGGTACAGCACCCTGGTGTTCGTGGAGGAACCAACTGACTG TCCTA |
| 227. | MCSP-F9 VH-VL-P x G4H VH-VL-P | artificial | aa | EVQLQESGPGLVKPSETLSLTCVVSGGSISSSNWMSWVRQPPGKGLEWLGTIYNGNTYYNPSLK SRVTISVDTSKNQFSLRLSSVTAADTAVYYCAKSWSWFASWGQGTLVTVSSGGGGSGGGGSGG GSELVMTQSPDSLAVSLGERATINCKSSQSVLSSSNNKNYLNWYQQKPGQPPKLLIYWASTRESG VPDRFSGSGSGTDFTLTISSLQAEDVAVYYCQQHYSVPFTFGPGTKVDIKSGGGGSEVQLLESGG GLVQPGGSLKLSCAASGFTFNRYAMNWVRQAPGKGLEWVARIRSKYNNYATYYADSVKGRFTISR DDSKNTAYLQMNNLKTEDTAVYYCVRHGNFGNSYLSYFAYWGQGTLVTVSSGGGGSGGGGSGGGG SELVVTQEPSLTVSPGGTVTLTCGSSTGAVTSGYYPNWVQQKPGQAPRGLIGGTKFLAPGTPARF SGSLLGGKAALTLSGVQPEDEAEYYCALWYSNRWVFGGGTKLTVL |
| 228. | MCSP-F9 VH-VL-P x G4H VH-VL-P | artificial | nt | GAGGTGCAGCTGCAAGAGTCTGGCCCAGGACTGGTGAAGCCTTCGGAGACCCTGTCCCTCACCTG CGTTGTCTCTGGTGGCTCCATCAGCAGTAGTAACTGGTGGAGCTGGGTCCGCCAGCCCCCAGGGA AGGGACTGGAGTGGCTTGGGACTATCTATTATAATGGGAATACCTACTACAACCCGTCCCTCAAG AGTCGAGTCACCATCTCCGTAGACACGTCCAAGAACCAGTTCTCCCTGAGGCTGAGCTCTGTGAC CGCCCAGACACGGCCGTGTATTACTGTGCGAAATCCTGGGTCTCTGGTTTGCTTCCTGGGGTC AAGGAACCTTGGTCACCGTCTCCTCAGGTGGTGGTTCTGGCGGCGGCGGCTCCGGTGGTGGT GGTTCTGAGCTCGTGATGACACAGTCTCCTGATTCTCTGGCTGTGTCTCTGGGCGAGAGGCCAC CATCAACTGCAAGTCCAGCCAGAGTGTCTTATCCAGCTGCTAATAAGAACTATTAAATTGT ACCAGCAGAAACCAGGACAGCCTCCTAAGTTGCTCATTTACTGGGCATCTACCCGGGAATCCGGG GTCCCTGACCGATTCAGTGGCAGTGGGTCTGGGACAGATTTCACTCTCACCATCAGCAGCCTGCA GGCTGAAGATGTGGCAGTTTATTACTGTCAGCAACATTATAGTGTTCACTTCGGCCCCTG GGACCAAAGTGGATATCAAATCCGGAGGTGGTGGATCTCATGTGCAGCTGCTGGAGTCTGAGGA GGATTGGTGCAGCCTGGAGGGTCATTGAAACTCTATGTGCAGCCTCTGGATTCACCTTCAATCG CTACGCCATGAACTGGGTCCGCCAGGCTCCAGGAAAGGGTTTGGAATGGTTGCTCGATAAGA |

-continued

| SEQ ID NO. | DESIGNATION | SOURCE | TYPE | SEQUENCE |
|---|---|---|---|---|
| | | | | GTAATATAATAATTATGCAACATATTATGCGATTCAGTGAAGGGAGGTTCACCATCTCCAGA<br>GATGATTCAAAAACACTGCCTATCTACAAATGAACAACTTGAAAACTTGAGGACACTGCCGTGTA<br>CTACTGTGTGAGACATGGAACTTCGGTAATAGCTACTTATCTCGCTTACTCGCTTACTGGGCCAAG<br>GGACTCTGGTCACCGTCTCCAGGTGGTTCTGGCGGCGGCTCCGGTGGTGGTGGT<br>TCTGAGCCTGTTGACTCAGGAACCTTCACTCACCGTATCCACCTGTGAACAGTCACTCAC<br>TTGTGGCTCTCGACTGGGCTGTTACATCGGACTAGTTCCTGCCCCGTACTCCTGCCAGATTC<br>GTCAGGCACCCCGTGTCTTGAGGCAAGCTGCCCTACCTCACCCTCAGGGGTACAGCCAGAGGATGAGGC<br>TCAGCTCTGTGCTCTATGGTACAGCACCGCTGGGTGTTCGGTGGAGGAACCAAACTGACTG<br>AGAATATTACTGTGCTCTATGGTACAGCACCGCTGGGTGTTCGGTGGAGGAACCAAACTGACTG<br>TCCTA |
| 229. | 1-27 CD3ε-Fc | artificial | aa | QDGNEEMGGITQTPYKVSISGTTVILTSGEPKSCDKTHTCPPCPAPELLGGPSVFLFPPKPKDTL<br>MISRTPEVTCVVVDVSHEDPEVKFNWYVDGVEVHNAKTKPREEQYNSTYRVVSVLTVLHQDWLNG<br>KEYKCKVSNKALPAPIEKTISKAKGQPREPQVYTLPPSREEMTKNQVSLTCLVKGFYPSDIAVEW<br>ESNGQPENNYKTTPPVLDSDGSFFLYSKLTVDKSRWQQGNVFSCSVMHEALHNHYTQKSLSLSPG<br>KHHHHHH |
| 230. | 1-27 CD3ε-Fc | artificial | nt | ATGGATGAGCTGTATCATCCTCTTCTTGGTAGCAACAGCTACAGGTGTACACTCCCAAGATGG<br>TAATGAAGAAATGGGTGGTATTACACAGACACCATATAAAGTCTCCATCTGGAACCACAGTA<br>TATTGACATCCGGAGAGCCCAAATCTTGTGACAAATCTCACAATGCCACCGTGCCAGCACCT<br>GAACTCCTGGGGGACCCTCAGTCTCTTCCCCCCAAAACCCAAAGGACACCCTGAGGTCACATCTC<br>CCGGACCCCTGAGGTCACATGCGGTGGTGGACGTGAGCCACGAAGACCCTGAGGTCAAGTTCA<br>ACTGGTACGTGGACGGCGTGGAGGTGCATAATGCCAAGACAAAGCCGCGGGAGGAGCAGTACAAC<br>AGCACGTACCGTGTGTCCAGCGTCCTCACCGTCCTGCACCAGGACTGGCTGAATGGCAAGGAGTA<br>CAAGTGCAAGGTCTCCAACAAAGCCCTCCCAGCCCCCATCGAGAAAACCATCTCCAAAGCCAAAG<br>GGCAGCCCCGAGAACCACAGGTGTACACCCTGCCCCCATCCCGGGATGAGCTGACCAAGAACCAG<br>GTCAGCCTGACCTGCCTGGTCAAAGGCTTCTATCCCAGCGACATCGCCGTGGAGTGGGAGAGCAA<br>TGGGCAGCCGGAGAACAACTACAAGACCACGCCTCCCGTGCTGGACTCCGACGGCTCCTTCTTC<br>TCTATAGCAAGCTCACCGTGGACAAGAGCAGGTGGCAGCAGGGGAACGTCTTCTCATGCTCCGTG<br>ATGCATGAGGCTCTGCACAACCACTACACGCAGAAGAGCCTCTCCCTGTCCCCGGGTAAACATCA<br>TCACCATCATCAT |
| 231. | human 1-27 CD3ε-EpCAM | artificial | aa | QDGNEEMGGITQTPYKVSISGTTVILTDYKDDDDKTASFAAAQKECVCENYKLAVNCFLNDGQC<br>QCTSIGAQNTVLCSKLAAKCLVMKAEMNGSKLGRRAKPEGALQNNDGLYDPDCDESGLFKAKQCN<br>GTSTWCVNIAGVRRTDKDTEITCSERVRTYWIIIELKHKAREKPYDVQSLRTALEEAIKTRYQL<br>DPKFITNILYEDNVITIDLVQNSSQKTQNDVDIADVAYYFEKDVKGESLFHSKKMDLRVNGEQLD<br>LDPQGTLIYYVDEKAPEFSMQGLKAGVIAVIVVVIAIVAGIVVLVISRKKRMAKYEKAEIKEMG<br>EMHRELNA |
| 232. | human 1-27 CD3ε-EpCAM | artificial | nt | ATGGATGAGCTGTATCATCCTCTTCTTGGTAGCAACAGCTACAGGTGTACACTCCCAAGATGG<br>TAATGAAGAAATGGGTGGTATTACACAGACACCATATAAAGTCTCCATCTGGAACCACAGTAA<br>TATTGACATCCGGAGAGCCCAAATCTTGTGACAAATCTCACAATGCCACCGTGCCAGCACCT<br>GAACTCCTGGGGGACCCTCAGTCTCTTCCCCCCAAAAGACACCTGAGGTCACATCTC<br>CCGGACCCCTGAGGTCACATGCGGTGGTGGACGTGAGCCACGAAGACCCTGAGGTCAAGTTCA<br>ACTGGTACGTGGACGGCGTGGAGGTGCATAATGCCAAGACAAAGCCGCGGGAGGAGCAGTACAAC<br>AGCACGTACCGTGTGTCCAGCGTCCTCACCGTCCTGCACCAGGACTGGCTGAATGGCAAGGAGTA<br>CAAGTGCAAGGTCTCCAACAAAGCCCTCCCAGCCCCCATCGAGAAAACCATCTCCAAAGCCAAAG<br>GGCAGCCCCGAGAACCACAGGTGTACACCCTGCCCCCATCCCGGGATGAGCTGACCAAGAACCAG<br>GTCAGCCTGACCTGCCTGGTCAAAGGCTTCTATCCCAGCGACATCGCCGTGGAGTGGGAGAGCAA<br>TGGGCAGCCGGAGAACAACTACAAGACCACGCCTCCCGTGCTGGACTCCGACGGCTCCTTCTTC<br>AATTTATCACAAAACTCAGAATGATGTGGACATAGCTGATGTGGCTTATTATTTGAAAAGATGTTAAAGT |

| SEQ ID NO. | DESIGNATION | SOURCE | TYPE | SEQUENCE |
|---|---|---|---|---|
| | | | | GAATCCTTGTTCATTCTAAGAAAATGACCTGAGAGTAAATGGGAACAACTGGATCTGGATCC<br>TGGTCAAACTTTATTGCTGTTATTATTATGTCGATGAAAAGCACCTGAATTCTCAATGCAGGGTCTAAAAG<br>CTGTGTTATTGCTGTTATTGTGTGTTGGTGATAGCAATGTTGCTGAATTGTTGTCTGGTT<br>ATTTCCAGAAGAAGAAGAATGGCAAAGTATGAGAAGGCTGAGATAAAGGAAGATGGGTGAGATGCA<br>TAGGGAACTCAATGCA |
| 233. | marmoset 1-27 CD3□e-EpCAM | artificial | aa | QDGNEEMGDTTQNPYKVSISGTTVTLTDYKDDDDKTASFAAAQKECVCENYKLAVNCFLNDNGQC<br>QCTSIGAQNTVLCSKLAAKCLVMKAEMNGSKLGRRAKPEGALQNNDGLYDPDCDESGLFKAKQCN<br>GTSTCWCVNTAGVRRTDKDTEITCSERVRETYWIIIELKHKAREKPYDVQSLRTALEEAIKTRYQL<br>DPKFTNILYEDNVITIDLVQNSSQKTQNDVIADVAYYFEKDVKGESLFHSKKMDLRVNGEQLD<br>LDPGQTLIYYVDEKAPEFSMQGLKAGVIAVIVVVIAIVAGIVVLVISRKKRMAKYEKAEIKEMG<br>EMHRELNA |
| 234. | marmoset 1-27 CD3□e-EpCAM | artificial | nt | ATGGATGAGCTGTATCATCCTCTTCTTGGTAGCAACAGCTACAGGTGTACACTCCAGGACGG<br>TAATGAAGAAATGGGTGATACTACAAGAACCCATATAAAGTTTCCATCTCAGGAACCACAGTAA<br>CACTCGACAGATTACAAGGACGACAAGACTGCCGAGTTTTGCCGCAGCTCAATGCCAGTGTAC<br>GTCTGTGAAAACTACAAGCTGGCCGTAAACTGCTTTTGAATGACAATGTCAATGCCAGTGTAC<br>TTCGATTGGTGCACAAAATACTGTCCTTTGCTCAAAGCTGGCTGCCAAATGTTTGGTGATGAAGG<br>CAGAAATGAACGGCTCAAAACTGGCGTAAACTGGAGAGCCCAAACCTGAAGGGCTCTCCAGACAATGAT<br>GGCCTTTACGATCCTGACTGCGATGAGAGCGGGCTCTTTAAGGCCAAGCAGTGCAACGCACCTC<br>CACGTGCTGGTGTGAACACTGGGGTCGGGCTGAAAATGGACCTACGAGTAAATGGGACCAACCTGCT<br>CTGAGCGAGTGAGAACCTACTGACTCATCATTGAATTAATAAACAAAGCAAGAGAAAACCTTAT<br>GATGTTCAAAGTTTCGGACTGCACTTGAGGAGGCGATCAAAACCGTTATCACTATTGGTTCAAA<br>ATTTATCACAAAACTCAGAATGATGTGTGGTTGTCGATGAAAAAGACCACCTGAATTCTGCTCC<br>AGAAAACCTGTTCATTCTAAGAAAATGACCTGAGAGTAAATGGGAACAACTGGATCTGGATCC<br>TGGTCAAACTTTATTGCTGTTATTATTATGTCGATGAAAAGCACCTGAATTCTCAATGCAGGGTCTAAAG<br>CTGTGTTATTGCTGTTATTGTGTGTTGGTGATAGCAAGGCTGAGATAAAGGAAGATGGGTGAGATGCA<br>ATTTCCAGAAGACTCAATGCA |
| 235. | tamarin 1-27 CD3□e-EpCAM | artificial | aa | QDGNEEMGDTTQNPYKVSISGTTVTLTDYKDDDDKTASFAAAQKECVCENYKLAVNCFLNDNGQC<br>QCTSIGAQNTVLCSKLAAKCLVMKAEMNGSKLGRRAKPEGALQNNDGLYDPDCDESGLFKAKQCN<br>GTSTCWCVNTAGVRRTDKDTEITCSERVRETYWIIIELKHKAREKPYDVQSLRTALEEAIKTRYQL<br>DPKFTNILYEDNVITIDLVQNSSQKTQNDVIADVAYYFEKDVKGESLFHSKKMDLRVNGEQLD<br>LDPGQTLIYYVDEKAPEFSMQGLKAGVIAVIVVVIAIVAGIVVLVISRKKRMAKYEKAEIKEMG<br>EMHRELNA |
| 236. | tamarin 1-27 CD3□e-EpCAM | artificial | nt | ATGGATGAGCTGTATCATCCTCTTCTTGGTAGCAACAGCTACAGGTGTACACTCCAGGACGG<br>TAATGAAGAAATGGGTGATACTACAAGAACCCATATAAAGTTTCCATCTCAGGAACCACAGTAA<br>CACTCGACAGATTACAAGGACGACAAGACTGCCGAGTTTTGCCGCAGCTCAATGCCAGTGTAC<br>GTCTGTGAAAACTACAAGCTGGCCGTAAACTGCTTTTGAATGACAATGTCAATGCCAGTGTAC<br>TTCGATTGGTGCACAAAATACTGTCCTTTGCTCAAAGCTGGCTGCCAAATGTTTGGTGATGAAGG<br>CAGAAATGAACGGCTCAAAACTGGCGTAAACTGGAGAGCCCAAACCTGAAGGGCTCTCCAGACAATGAT<br>GGCCTTTACGATCCTGACTGCGATGAGAGCGGGCTCTTTAAGGCCAAGCAGTGCAACGCACCTC<br>CTGAGCGAGTGAGAACCTACTGACTCATCATTGAATTAATAAACAAAGCAAGAGAAAACCTTAT<br>GATGTTCAAAGTTTCGGACTGCACTTGAGGAGGCGATCAAAACCGTTATCACTATTGGTTCAAA<br>ATTTATCACAAAACTCAGAATGATGTGTGGTTGTCGATGAAAAAGACCACCTGAATTCTGCTCC<br>AGAAAACCTGTTCATTCTAAGAAAATGACCTGAGAGTAAATGGGAACAACTGGATCTGGATCC |

-continued

| SEQ ID NO. | DESIGNATION | SOURCE | TYPE | SEQUENCE |
|---|---|---|---|---|
| | | | | TGGTCAAACTTAATTATTATGTCGATGAAAAGCACCTGAATTCTCAATGCAGGGTCTAAAAG CTGGTGTTATTGCTGTTATTGTGGTTGTGCTGGTAGCAATTGTTGCTGCTGGTT ATTTCCAAGAAGAAGAATGGCAAAGTATGAGAAGGCTGAGATAAAGGAGATGGGTGAGATGCA TAGGGAACTCAATGCA |
| 237. | squirrel monkey 1-27 CD3□e-EpCAM | artificial | aa | QDGNEEIGDTTQNPYKVSISGTTVLTLTDYKDDDDKTASFAAAQKECVCENYKLAVNCFLNDNGQC QCTSIGAQNTVLCSKLAAKCLVMKAEMNGSKLGRRAKPEGALQNNDGLYDPDCDESGLFKAKQCN GTSTCWCVNTAGVRRTDKDTEITCSERVRTYWIIIELKHKAREKPYDVQSLRTALEEAIKTRYQL DPKFITNILYEDNVITIDLVQNSSQKTQNDVDIADVAYYFEKDVKGESLFHSKKMDLRVNGEQLD LDPGQTLIYVDEKAPEFSMQGLKAGVIAIVVVVIAIVAGIVVLIVISRKKRMAKYEKAEIKEMG EMHRELNA |
| 238. | squirrel monkey 1-27 CD3□e-EpCAM | artificial | nt | ATGGGATGGAGCTGTATCATCCTCTTCTTGGTAGCAACAGCTACAGGTGTACACTCCCAGGACGG TAATGACAGATTGTGATCTACAAGGACGACCCATATAAAGTTTCCATCTCAGGACACCAGTAA CACTGACAGATTACAAGGACGACGATGGAACTCTTAAAGACTTGCGAGTTTTGCCGCAGCTCAGAAAGAATGT GTCTGTGAAACTACAAGCTGGCCCTGTAAACTGCTTTTCCTTAAAGCCGAGTCAATGCCAGTGTAC TTCGATTGGTGCAAAATCGTCCTTTGCTCAAAGCTGGCTGGCAAATGTTTGGTGATGAAGG CAGAAATGAACGGCTCAAAACTTGGAGGAGAGCAAACTGAAACCTCAGAACAATGAT GGCCTTTACCATCCTGACTGCGATGAGAGCGGGTCTTTTAAGGCCAAGGACACTGAACGGCACCTC CACGTGCTGGTGTGAACACTGGACCTGATCATCATTGAAATAAAACACTGACAAGAACCTGCT CTGAGCGAGTGAGAACCTACTGACGTTATCGTTATCAACGGCAAATCGTTATCAACTGGATCCAA ATTTATCACAAATATTTGTAGAGCATAAATGGACCTGACATACAACGATTCGGATCCAAA GAAATCCTTGTTTCATTCTAAGAACATGGGATGTCGATGACAGATAAAATGGGGAACAACTGGATCTGGATCC TGGTCAAACTTAATTATTATGTCGATGAAAAGCACCTGAATTCTCAATGCAGGGTCTAAAAG CTGGTGTATTGCTGTTATTGTGGTTGTGCTGGTAGCAATTGTTGCTGCTGGTT ATTTCCAAGAAGAAGAATGGCAAAGTATGAGAAGGCTGAGATAAAGGAGATGGGTGAGATGCA TAGGGAACTCAATGCA |
| 239. | swine 1-27 CD3□e-EpCAM | artificial | aa | QEDIERPDEDTQKTFKVSISGDKVELTDYKDDDDKTASFAAAQKECVCENYKLAVNCFLNDNGQC QCTSIGAQNTVLCSKLAAKCLVMKAEMNGSKLGRRAKPEGALQNNDGLYDPDCDESGLFKAKQCN GTSTCWCVNTAGVRRTDKDTEITCSERVRTYWIIIELKHKAREKPYDVQSLRTALEEAIKTRYQL DPKFITNILYEDNVITIDLVQNSSQKTQNDVDIADVAYYFEKDVKGESLFHSKKMDLRVNGEQLD LDPGQTLIYVDEKAPEFSMQGLKAGVIAIVVVVIAIVAGIVVLIVISRKKRMAKYEKAEIKEMG EMHRELNA |
| 240. | swine 1-27 CD3□e-EpCAM | artificial | nt | ATGGGATGGAGCTGTATCATCCTCTTCTTGGTAGCAACAGCTACAGGTGTACACTCCCAAGAAGA CATTGAAAGACCAGATGAAGATACACAGAAAACATTTAAAGTCTCCATCTCTGGAGACAAAGTAG AGCTGACAGATTACAAGGACGACGATGACAAGACTGCGAGTTTTGCCGCAGCTCAGAAAGAATGT GTCTGTGAAACTACAAGCTGGCCCTGTAAACTGCTTTTCCTTAAAGCCGAGTCAATGCCAGTGTAC TTCGATTGGTGCAAAATCGTCCTTTGCTCAAAGCTGGCTGCAAATGTTTGGTGATGAAGG CAGAAATGAACGGCTCAAAACTTGGAGGAGAGCAAACTGAAACCTCAGAACAATGAT GGCCTTTACCATCCTGACTGCGATGAGAGCGGGTCTTTTAAGGCCAAGGACACTGAACGGCACCTC CACGTGCTGGTGTGAACACTGGACCTGATCATCATTGAATTAAAACACTGACAAGAACCTGCT CTGAGCGAGTGAGAACCTACTGACGTTATCGCTTATCAACGGCAAATCGTTATCAACTGGATCCAA ATTTATCACAAATATTTGTAGAGCATAAATGGACCTGACATACAACGATTTGGATCCAAA GAAATCCTTGTTTCATTCTAAGAACATGGGATGTCGATGACAGATAAAATGGGGAACAACTGGATCTGGATCC TGGTCAAACTTAATTATTATGTCGATGAAAAAGCACCTGAATTCTCAATGCAGGGTCTAAAG |

-continued

| SEQ ID NO. | DESIGNATION | SOURCE | TYPE | SEQUENCE |
|---|---|---|---|---|
| | | | | CTGGTGTTATTGCTGTTATTGTGGTTGTGCTGATAGCAATTGTTGCTGAATTGTTGCTGGTT ATTTCCAGAAGAAGAAGAATGGCAAAGTATGAGAAGGCTGAGATAAAGGAGATGGGTGAGATGCA TAGGGAACTCAATGCA |
| 241. | human CD3 epsilon chain | human | aa | QDGNEEMGGITQTPYKVSLSGTTVILTCPQYPGSEILWQHNDKNIGGDEDDKNIGSDEDHLSLKE FSELEQSGYYVCYPRGSKPEDANFYLYLRARVCENCMEMDVMSVATIVIVDICITGGLLLLVYYW SKNRKAKAPVTRGAGAGRQRGQNKERPPPVPNPDYEPIRKGQRDLYSGLNQRRI |
| 242. | human CD3 epsilon chain | human | nt | ATGGTGTCGGGCACTCACTGGAGAGTTCTGGGCCTCTGCCTCTTATCAGTGGCGTTTGGGGCA AGATGTAATGAAGAATGGTGGTATTACACAGACACCATATAAAGTCTCCATCTCTGAACCA CAGTAATATTGACATGCCCTCAGTATCCTGGATCTGAAATACTATGGCAACACAATGATAAAAC ATAGCCGTGATGAGGACATGAATAAAACATAGGCAGTGATGAGGATCACCTGTCACTGAGGAATT TTCAGAATTGGAGCAAAGTGGTTATTATGTCTGTTGAGAACTGCCCAGAGGAAGCAAACCAGAAGATGCGA ACTTTATCTCTACCTGAGGGCACGTGTGGATCAGATCTGGGGCTTGCTGCTGTTTACTACTGAG GCCACAATTGTCATAGTGGACATCTGCATCACTGGGCTTGCTGCTGTGGCGCAGGCAAAGG GACAAATAGAAAGGCCAAGGCCACCACCACCACCACCGTTCCCAACCCAGACTATGAGCCCATCCGAAAGGCCAG CGGGACCTGTATTCTGGCCTGACAGAGACGCATC |
| 243. | 19 amino acid immunoglobulin leader peptide | artificial | aa | MGWSCIILFLVATATGVHS |
| 244. | 19 amino acid immunoglobulin leader peptide | artificial | nt | ATGGGATGGAGCTGTATCATCCTCTTCTTGGTAGCAACAGCTACAGGTGTACACTCC |
| 245. | murine IgG1 heavy chain constant region | murine | aa | AKTTPPSVYPLAPGSAAQTNSMVTLGCLVKGYFPEPVTVTWNSGSLSSGVHTFPAVLQSDLYTLS SSVTVPSSTWPSETVTCNVAHPASSTKVDKKIVPRDCGCKPCICTVPEVSSVFIFPPKPDVLTI TLTPKVTCVVVDISKDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLTCMITDFFPEDITVEWQW NGQPAENYKNTQPIMDTDGSYFVYSKLNVQKSNWEAGNTFTCSVLHEGLHNHHTEKSLSHSPGK |
| 246. | murine IgG1 heavy chain constant region | murine | nt | GCCAAAACGACACCCCCATCTGTCTATCCACTGGCCCCTGGATCTGCTGCCCAAACTAACTCCAT GGTGACCCTGGGATGCCTGGTCAAGGGCTATTTCCCTGAGCCAGTGACAGTGACCTGGAACTCTG GATCCTCTGGGTCTTTACACACTTCCAGCAGCCAGCACCGTCACCTGCAACGTCACCAGCACCACCC AGCTCAGTGACTGTCCCCTCCAGCACCTGGCCCAGGCGAGCCGTCACCTGCAACGTTGCCCACCCC GGCCAGCAGCAGCCAAGGTGCACCAAGGTGGACAAGAAATTGCCCAGGAGATTGTGTTGTTGTAAGCCTTGCATAT GTACAGTCCCAGAAGTATCATCTGTCTTCATCTTCCCCCAAAGCCAAGGATGTGCTCACCATT ACTCTGACTCCTAAGGTCACGTGTGTGGGTAGACATCAGCAGGATGATCCCGAGGTCCAGTT CAGCTGGTTTGTAGATGATGGAGGTGCACACACAGCCTAGCACGACCAGAGCTGGCCTGAATGGCAAGGAG ACAGCACTTTCCGCTCAGTGACTTCCATCATGCACCAGGACTTGCCTCATGGACAAAACCAA TTCAATGCAGGGTCAACAGTGCAGTTTCCTTCCAGCTCAGAGAAAACATCTCCAAAACCA AGGCAGACCCGAAGGCTCCACAGTGTACACCATTCTCCCTGAAGACATTACTGTGAGTGGCAGTGG AAGTCAGTCTGACCTGCATGATAACAGACTTCTCCCTGAAGACATTACTGTGAGTGGCAGTGG AATGGGCAGCCAGCCGAGCTAATGTGCAGAAGAACACTCAGCCCATCATGGACACAGATGGCTCTTACTT CGTCTACAGCAAGCTCAATGTGCAGAAGAGCAACTGGGAGGCAGGAAATACTTTTCACCTGCTCTG TGTTACATGAGGGCCTGCACAACCACCATACTGAGAAGAGCCTCTCCCACTCTCCTGGTAAA |
| 247. | human lambda light chain constant region | human | aa | GQPKAAPSVTLFPPSSEELQANKATLVCLISDFYPGAVTVAWKADSSPVKAGVETTTPSKQSNNK YAASSYLSLTPEQWKSHKSYSCQVTHEGSTVEKTVAPTECS |

| SEQ ID NO. | DESIGNATION | SOURCE | TYPE | SEQUENCE |
|---|---|---|---|---|
| 248. | human lambda light chain constant region | human | nt | GGTCAGCCCAAGGCTGCCCCCTCGGTCACTCTGTTCCCACCCTCCTCTGAGGAGCTTCAAGCCAA<br>CAAGGCCACACTGGTGTGTCTCATAAGTGACTTCTACCCGGGAGCCGTGACAGTGGCCTGGAAGG<br>CAGATAGCAGCCCCGTCAAGGCGGGAGTGGAGACCACCACACCCTCCAAACAAAGCAACAACAAG<br>TACGCGGCCAGCAGCTACCTGAGCCTGACGCCTGAGCAGTGGAAGTCCCACAAAAGCTACAGCTG<br>CCAGGTCACGCATGAAGGGAGCACCGTGGAGAAGACAGTGGCCCCTACAGAGAATGTTCA |
| 249. | c-terminal domain construct of human MCSP | human | aa | DYKDDDDKSRTRSGSQLDGGLVLFSHRGTLDGGFRFRLSDGEHTSPGHFFRVTAQKQVLLSLKGS<br>QTLTVCPGSVQPLSSQTLRASSSAGTDPQLLLYRVVRGPQLGRLFHAQQDSTGEALVNFTQAEVY<br>AGNILYEHEMPPEPFWEAHDTLELQLSSPPARDVAATLAVAVSFEAACPQRPSHLWKNKGLWVPE<br>GQRARITVAALDASNLLASVPSPQRSEHDVLFQVTQFPSRGQLLVSEEPLHAGQPHFLQSQLAAG<br>QLVYAHGGGTQQQDFHFRAHLQGPAGASVAGPQTSEAFAITVRDVNERPPQPQASVPLRLTRGS<br>RAPISRAQLSVUDDSAPGEIEYEVQRAPHNGFLSLVGGGLGPVTRFTQADVDSGRLAPVANGSS<br>VAGIFQLSMSDGASPPLPMSLAVDILPSAIEVQLRAPLEVPQALGRSSLSQQQLRVVSDREEPEA<br>AYRLIQGPQYGHLLVGGRPTSAFSQPQIDQGEVVFAFTNSSSHDHFRVLALARGVNASAVVNVT<br>VRALLHVWAGGPMWPQGATLRLDPTVLDAGELANRTDSVPRFRLLEGPRHGRVVRPRARTEPGGS<br>QLVEQFTQQDLEDGRLGLVERGPEGRAPGPAGDSLITLELWAQGVPPAVASLDFATEPYNAARPYS<br>VALLSVPEAARTEAGKPESSTPTGEPGPMASSPEPAVAKGGFLSFLEANMFSVIIPMCLVLLLLA<br>LILPLLFYLRKRNKTGKHDVQVLITAKPRNGLAGDTETFRKVEPGQAIPLTAVPGQGPPPGQPDP<br>ELLQFCRTPNPALKNGQYMV |
| 250. | c-terminal domain construct of human MCSP | human | nt | ATGGGATGGAGCTGTATCATCCTCTTCTTGGTAGCAACAGCTACAGGTGTACACTCCGACTACAA<br>AGACGATGACGACAAGTCCCGTACCAGATCTGGATCCCAATTGGACGGCGGGCCTCGTGCTGTTCT<br>CACACAGAGGAACCCTGGATGGACGGCCTCGTCCTCTGACCAAGCAAGTGCTCCTCGCTGAAGGGCAGCAGACACT<br>GACTGTCTGCCCAGGTCCGTCCAGCTCCTGCGGAGCCCCTGAGTGCTGGTCCCCAGCTAGT<br>GCACTGTGCCCAGGTCCGTCCAGCTCCTCTACGGTGGTCGGGGACCCTCAGCTACGGCTGTTCAC<br>GCCCAGCAGGACAGCACAGGAGGGCCCTGGTGAACTTCACTCAGGCAGAGGTGTACGCGGGAA<br>TATTCTGTATGAGCATGAGAGATGAGCCCCCCGAGCCCTTTTGGGAGGCCATGATACCCTAGAGCTC<br>AGCTGTCCTGCCGCCCTGCCCGGACGTGCCCAGCACTCTGCTGGAGCTGCTGTTCTTTGAGGCT<br>GCCTGCCCAGCGCCCAGCCAGCTGCTCTGCAGTGCTGAAGAACAAAGTCTCTTGGCCAGCGTGCCCCGAGGGCCAGCG<br>GGCCAAGGATCACCGTGGCTGCTCCGGAGTGCACCAGTTCCCCAGCCGCGGCCAGCTGTTGGTGTCC<br>GAGGAGCCCCTCCATGCTGGGCCAGCCCCACTTCGTGCAGTCGCAGCTGCGTCCAGCAGCTAGT<br>GTATCCCACGCGCTGGGCCACCAGCAGGATGGCTTCCACTTTCGTGCCACCTCCAGGGC<br>CAGCAGGCGCCTCCGTGGCTGGAACCACAGCCTCTGTCCACTCCGGCTACCGGAGCTCTGTGCCC<br>AATGAGCGCCCGGCCAGCGTCTCAGCCACGCTGAGTGCTGCGTGGAACAAACCCTGGAGAATGTGAGTACGAGG<br>CATCTCCGGGCCACCACCACAGCCTTCCTCAGCCTGGTGGTGCCTGGGGCCGTGACCCCGC<br>TCCAGCGGGCACCCCACAACGCCTTCCTCAGCCTGGTGGTGCCTGGGGCCGTGACCCCGC<br>TTCACGCAAGCCGATGTGATCTCAGGGCCGCGTGCCTTCCGTTGCCAACCGGAGCAGCGTGGCAGG<br>CATCTTCAGCTGAGCATGTCTGATGGGGCCAGCCCCTGCCCATGTCCTGGCTGTGGACA<br>TCCTACCATCCGCCATCGAGGTGCAGCTGCGCCCACCACCCTGGAGGTGCCCCAAGCTTTGGGCGC<br>TCCTCACTGAGCCAGCAGCTCCGGGTGGGTTCAGATGGGAGTGGGAGGCAGCAGCATACCG<br>GTTGATCCAGGGCCCAGTATGGCCATCCTCCTGTGGGCCGGGCCCACCTCGGCCCTTTCAGC<br>AATTTCCAGATAGACCAGGGCGAGTGGTCTTAGGGGGTCAATGCATCAGCCGTAGTGAACGTCACTGTGAGGGC<br>TCTGCTCATGTGGTGGGCCAGGTGGGCCATGGCCCCAGACACCGCTTCCACCTTGGGCCTGACCCCACCG<br>TCCTAGATGCTGGCCAGCTGGCCAACCGACAGAGCAGTGTGCCCGCGTTCCGCCTCCTGAGGGA<br>CCCCGGCATGGCCGCGGCCGTGCGCGAGCAGGACCCTTGAGGACGGGACGGGGAGGTGGGAGGTGGGGCTGGCCAGCCTGGT<br>GGAGCAGTTCACTCAGCAGGACGTCTCACTCTGACAGTCTCACTGGGCAGCTGTGGGAGCTCTGGGCACAGAGAGAGG<br>GGAGGGCCCCGGCCCCGGACCTTCACTCTGAGCTGTGGGCAGCTGTGGGCACACCTCCGCCT |

| SEQ ID NO. | DESIGNATION | SOURCE | TYPE | SEQUENCE |
|---|---|---|---|---|
| | | | | GCTGTGGCCTCCCTGGACTTTGCCACTGAGCCTTACAATGTGCCCGGCCCTACAGCGTGGCCCT |
| | | | | GCTCAGTGTCCCCGAGGCCCCCCGACGGAAGCAGGGAAGCCAGAGAGCAGGAGCTTCCTGAGCTTCTA |
| | | | | AGCCAGGCCCCATGGCATCCAGCCTGAGCCCGCTGTGCCTCAAGGAGGAGCTTCCTGAGCTTTCTA |
| | | | | GAGGCCAAACATGTTCAGCGTCATCATCCCATGTGCCTGGTACTTCTGTCCTGGCGCTCATCCT |
| | | | | GCCCTGCTCTTCTACCTCCGAAAACGCAACAAGACGCCAAGCATGACGTCCAGGTCCTGACTG |
| | | | | CCAAGCCCTCACAGCTGTGCCTGCCTGGCAGGGGCCCCCTCCAGGAGGTGAGCCAGGCCAGGCC |
| | | | | ATCCCGCTCACAGCTGCCGACACCCAACCCTGCCCTTAAGAATGGCCAGTACTGGGTG |
| | | | | GCAGTTCTGCCGGACACCCAACCCTGCCCTTAAGAATGGCCAGTACTGGGTG |
| 251. | partial sequence of cynomolgus MCSP | cynomolgus | aa | PSNGRVLRAAPGTEVRSFTQAQLDGGLVLFSHRGTLDGGFRFGLSDGEHTSSGHFFRVTAQKQV |
| | | | | LLSLEGSRTLTVCPGSVQPLSSQTLRASSSAGTDPQLLLYRVRGPQLGRLFHAQQDSTGEALVN |
| | | | | FTQAEVYAGNILYEHEMPTEPFWEAHDTLELQLSSPPARDVAATLAVAVSFEAACPQRPSHLWKN |
| | | | | KGLWVPEGQRAKITMAALDASNLLASVPSSQRLEHDVLFQVTQPPSRGQLLVSEEPLHAGQPHFL |
| | | | | QSQLAAGQLVYAHGGGTQDGFHFRAHLQGPAGATVAGPGTVSEAFAITVRDVNERPPQPQASVP |
| | | | | LRITRGSRAPISRAQLSVVDPDSAPGEIEYEVQRAPHNGFLSLVGGPGPVNRFTQADVDSGRLA |
| | | | | EVANGSSVAGVFQLSMSDGASPPLPMSLAVDILPSAIEVQLQAPLEVPQALGRSSLSQQQLRVVS |
| | | | | DREEPEAAYRLIQGPKYGHLLVGGQPASAFSQLQIDQGEVVFAFTNESSSHDHFRVLALARGVNA |
| | | | | SAVNITVRALLHVWAGGPWPQGATFLRLDPTILDAGELANRTGSVPRFRLLEGPRHGRVVRPRA |
| | | | | RMEPCGSQLVEQFTQQDLEDGRLGLEVGRPEGRAPSPTGDSLITLELWAQCVPPAVASLDFATEPY |
| | | | | NAARPYSVALLSVPEATRTEAGKPESSTPTGEPGPMASSPVPAVAKGGPFLGFLEANMFSVIIPXC |
| | | | | LVLLLALLIPLLFYLRKRNKTGKHDVQVLTAKPRNGLAGDTETFRKVEPGQAIPLTAVPGQPP |
| | | | | PGGQDPELLQFCRTPNPALKNGQYWV |
| 252. | partial sequence of cynomolgus MCSP | cynomolgus | nt | CCCAGCAACGACGGTAGTGCTGCGGCGGGCCGGGCACCGAGGTGCGCAGCTTCACGCAGGC |
| | | | | CCAGCTGGATGGCCGGACTCGTGTCTGTTCTCACACAGGAGAACCCTGGATGGAGCTTCCGCTTCG |
| | | | | GCTCTCCGATGGCCGAGCACACTTCTTCCGAGTGACGCCCAGAGAAGCAAGTG |
| | | | | CTCCTCTCGCTGGAGGGCAGCCAGCTCCTCTGGACACTGACTGTCTGCGACCCAGCCACTCAGCAG |
| | | | | TCAGACCCCTCAGAGCCAGCTCCAGGCACCGACCCCAGCTGCTCTGCTCTACCGTGGTGC |
| | | | | GGGCCCCCAGCTAGGCCCGCTGTTCCATGCCGGCAGAGAGCACCGGGAGGCCACCAGACCCT |
| | | | | TTCACTCAGGCAGGCCATGATACCCCAGAGTCTATGGAATATTCTGATGAGCATGAGATGCCCACCAGACCCCT |
| | | | | CTGGAGGCCCATGATACCCCAGAGTCTGTGTCTTTTGAGCTGTGCCTGTCCCCAGCCACCTCTGAAGAAC |
| | | | | CCCTTGCTGTGGCTGTGTCTTTTGAGCTGTGCCTGTCCCCAGCCACCTCTGAAGAAC |
| | | | | AAAGGTCTCTGGGTCCCGAGGGCCAGCGGCCAAGATCACCATGGCTGCCTGGATGCTCCAA |
| | | | | CCTCTTGGCCAGCGTTCCATCATCCCAGCCGCCTAGAGACATGATGTCTTCCAGGTCACGCAGT |
| | | | | TCCCCAGCGGGGCCAGCTATTGGTGTCTGAGGAGCCCTCTCCGAGTGACGCCCAGAAGCAAGTG |
| | | | | CAGTCCCAGCTGGCTGCAGGGCAGCTAGTGTATGCCAGCAGGGCCACCGTGGCTGGGGTACCCAACAGGATGG |
| | | | | CTTCCACTTTCGTGCCATCACGGTCGGAGGTCTATGCTGGGATATTCTGTATGAGCATGAGATGCCCACCAGACCC |
| | | | | AGGCTTTTGCCATCACCCGAGGCTTCCGAGCCCCATCTCCGGGCCCAGCTGAGTGTGCTGGACCCAGA |
| | | | | CTCCGATCACCCGAGGCTTCCGAGCCCCATCTCCGGGCCCAGCTGAGTGTGCTGGACCCAGA |
| | | | | CTCAGCTCCTCGGGAGATTGAGTATGAGGTCCAGCGGCACCCCACAACGCTTCCTCAGCCTGG |
| | | | | TGGGTGGTGCCCGGGCCCGGAACCGTTCACGCAGGCCGTTTCACGCATGTGACCATGCTTGGGGCCAGCC |
| | | | | TTCGGGCCAACGGACAGCAGCCAGTCCCTGCCGTGACATCCTACCATCCGCCATCGAGGTGACCTGCAGGCAC |
| | | | | ACCGTCGCCATGTCCTGCCGTGACATCCTACCATCCGCCATCGAGGTGACCTGCAGGCAC |
| | | | | CCCTGGAGGTGCCCCATGTCCCCAAGCTTTGGGGCGCTCTCACTGAGCCAGCAGCTCCGGGTGTTTCA |
| | | | | GATAGGGAGGAGCCAGAGCCCAGAGCATACCGCCTCAGCCAACTCCAGATAGAACCAAGGCGCAGGTCATCTCCTGT |
| | | | | GGGTGGGCAGCCCCTCGGCTTCGCTCTCTCCTCGCCAACTCCAGATAGAACCAAGGCGCAGGTGGTCTTTGCCT |
| | | | | TCACCAACTTCTCCTCCTCCTCAGCCACCTTCAGAGTCTGGCACTGGCTAGGGGTGTCAACGCA |
| | | | | TCAGCCGTACTACCCTGCGGCCTGAACATCACTGAGGGCTCTGCTGCACCTGTGGCCAGCGGCAGCTGGGCCAGCCATGGCCCA |
| | | | | GGGTGCTACCCTGCGGCCTGAACATCACTGAGGGCTCTGCTGCCCGTGGCCAGCGGCAGCTGGGCCAGCCATGGCCCA |
| | | | | GTGTGCCCCGCTTCCGCCTTCCTGGAGGGACCCCAGCTGGTGAGCCAGGACCTTCACTCAGCAGGACCTTGAGGATGGGAG |
| | | | | AGGATGAGCCTGGGGGCAGCCAGCTGGTGAGCCAGGACCTTCACTCAGCAGGACCTTGAGGATGGGAG |

-continued

| SEQ ID NO. | DESIGNATION | SOURCE | TYPE | SEQUENCE |
|---|---|---|---|---|
| | | | | GCTGGGGCTGGAGGTGGGCAGGCAGGGCCAGAGGGAAGGGCCCCAGCCCCACAGGCGACAGTCTCACTC<br>TGGAGCTGTGGGCACAGGGCGTCCCACCTGTGCCTCTGTGGCCTCTGTGCCTCAGTCTCCACTGACTTTGCCACTGAGCCTTAC<br>AATCTGCCCGGCCCTACAGCGTGGCCTGCCAGTGTCCAGTGTCCCGAGGCCACCCGACGAAGCAGG<br>GAAGCCAGAGAGCAGCACCCCCAGGCCAGGCCATGCATTCAGTGTCATCATCCCCCRTGTGC<br>TGGCCAAGGAGGCTTCCTGGGCTTCCTTGAGGCCAACATGTTCAGTGTCATCATCCCCRTGTGC<br>CTGGTCCTTCTGCTCCTGGCTCATCTTGCCCCTGCTCTTCTACCTCCGAAAACGCAACAAGAC<br>GGGCAAGCATGACTCCAGGTCCGACTGCCAAGCCCCGCTGACTGCCCAATGTCTGGCTGTGACACTGACA<br>CCTTTCGCAAGGTGGAGCCAGGCCAGGCCATCCCGCTCACAGCTGTGCCTGGCCAGGGCCCCT<br>CCGGAGGCCAGCCAGCCCAGAGCTGCTGCCAGTTCTGCCGACCAACCCCTGCCCTTAAGAA<br>TGGCCAGTACTGGGTG |
| 253. | PCR primer for CD3ε chain-forward primer | artificial | nt | AGAGTTCTGGGCCTCTGC |
| 254. | PCR primer for CD3ε chain-reverse primer | artificial | nt | CGGATGGGCTCATAGTCTG |
| 255. | His6-human CD3ε | artificial | aa | HHHHHHQDGNEEMGGITQTPYKVSISGTTVILTCPQYPGSEILWQHNDKNIGSDEDDKNIGSDED<br>HLSLKEFSELEQSGYYVCYPRGSKPEDANFYLYLRARVCENCMEMDVMSVATIVIVDICITGGLL<br>LLVYWSKNRKAKAPKVTRGAGAGRQRGQNKERPPPVPNPDYEPIRKGQRDLYSGLNQRRI |
| 256. | His6-human CD3ε | artificial | nt | ATGGATGGAGCTGTATCATCCTCTTCTTGGTAGCAACAAGCTACAGGTGTACACTCCATCATCA<br>CCATCATCATCAAGATGGTAATGATATTGACATGCCCCTAGTATTCCCTGATCTGAAATACTATGCAACAC<br>TCTCTGAACCACAGTAATAATTGACATGCCCCTAGTATTCCCTGATCTGAAATACTATGCAACAC<br>AATGATAAAAAACATAGGCCGTGATGAGGATGTAAAAAACATAGGCAGTGATGAGGATCACCTGTC<br>ACTGAAGGAATTTTCAGAATTGAGCAAAGTGGTTATTATGTCTGCTACCCCAGAGAGCAAAC<br>CAGAAGATGCGAACTTTTATCTTCACCTGAGGGCACGGTGTGTAGAACTGCATGGAGATGGAT<br>GTGATGTCCGTGCGCCACAATTGTCATAGTGGACATTCGACATCACTGGGGCTTGCTGCTGCTGT<br>TTACTACTGAGCAAGAATAGAAGGCCAAGGCCAACGCCACCACCTGTGACACGAGGAGCGGGTGCTGCG<br>GCAGCAAAGGGACCAAAACAGGAGGCCAAAACCACCTGTTCCAACCAGACTATGAGCCCATC<br>CGGAAAGGCCAGCCAGCCTGTATTCTGGCCTGAATCAGAGACGCATC |
| 257. | CD33 AH3 HL × H2C HL | artificial | aa | QVQLVQSGAEVKKPGESVKVSCKASGYTFTNYGMNWVRQAPGQGLEWMGWINTYTGEPTYADDFK<br>GRVTMSSDITSTSTAYLEINSLRSDDTAIYYCARMSWSDGYYVFDYWGQGTTVTVSSggggsggg<br>ggggsDIVMTQSPDSLTVSLGERTTINCKSSQSVLDSSKNKNSLAWYQQKPGQPPKLLLSWAS<br>TRESGIPDRFSGSGSGTDFTLTIDSLQPEDSATYYCQQSAHFPITFGQGTRLEIKSGGGSEVQL<br>VESGGGLVQPGGSLKLSCAASGFTFNKYAMNWVRQAPGKGLEWVARIRSKYNNYATYYADSVKDR<br>FTISRDDSKNTAYLQMNNLKTEDTAVYYCVRHGNFGNSYISYWAYWGQGTLVTVSSGGGSGGGG<br>SGGGGSQTVVTQEPSLTVSPGGTVTLTCGSSTGAVTSGYYPNWVQQKPGQAPRGLIGGTKFLAPG<br>TPARPGSGLLGGKAALTLSGVQPEDEAEYYCALMYSNRWVFGGGTKLTVL |
| 258. | CD33 AH3 HL × H2C HL | artificial | nt | CAGGTGCAGCTGGTGCAGTCTGGAGCTGAGGTGAAAAAGCCTGGAGAGTCAGTCAAGGTCTCCTG<br>CAAGGCTAGCGGGTATACCTTCACAAACATATGGAATGAACTGGGTGAGGCAGGCTCCAGGACAGG<br>GTTTAGAGTGGATGGGCTGATTCGATAAACACCTACACTGGAGAGCCAACATATGCTGATGACTTCAAG<br>GGACGGGTTACACGGCTATATTATTACTGCGCCCAAGGCACTGCTATTGGAAATCAACAGCCTCAG<br>AAGTGATGACACGGCTATATTATTACTGCGCCCAAGGCACTGCTATTGGAAATCAACAGCCTCAG<br>TTGACTACTGGGCCAAGGGACCACGGTCACCGTCTCCTCAGGTGGTGGTTCTGGCGGCGGC<br>GGCTCCGGTGGTGGTGGATCTGACATTGTGATGACACAGTCTCCAGACTCTCCTGGTGTCTCT<br>GGGCGAGAGGACCACCATCAACTGCAAGTCCAGCCAGAGTGTTTTAGACAGCTCCAAGAATAAGA<br>ACTCCTTAGCTTGGTACCAGCAGAAACCAGGACAGCCTCCTAAATTACTCCTTTCCTGGCATCT<br>ACGCGGGAATCCGGAGTCCCTGACCGATTCAGTGGCAGCGGGTCTGGGACAGATTTCACTCTCAC |

| SEQ ID NO. | DESIGNATION | SOURCE | TYPE | SEQUENCE |
|---|---|---|---|---|
| | | | | TATTGACAGGCTGCAGCCTGAAGATTCTGCAACTTACTATTGTCAACAGTCTGCCCACTTCCCGA |
| | | | | TCACCTTTGGCCAAGGGACACGACTGGAGATTAAATCCGAGGTGGTGCCTCAGGTGCAGCCTG |
| | | | | GTCGAGTCTGGAGGAGGATTGGTGCAGCCTGGAGGGTCCGCCAGGTCATTGAAACTCTCATGTGCAGCCTCTGG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAAATATAATAATTATGGCAAGACATATATGCGATTCAGTGAAGACAGG |
| | | | | TTCACCATCTCCAGAGATGATTCAAAAAACACTGCTATTCGGTAATGCTACTACTATCCTACTGGG |
| | | | | GGAACTGCCGTGTACTACTGTGTGAGACATGGAACTTCGGTAATGACTACTACTATCCTACTGGG |
| | | | | CTTACTGGGCCAAGGGACTCTGGTCACCGTCTCCTCAGGTGGTGGTGGTTCTGGCGGCGGC |
| | | | | TCCGGTGGTGGTGGTTCTCAGACTGTTGTCACCCAGGAACCCTCACTCACTGTCTCCGGGCTGGTG |
| | | | | AACAGTCACTCACTTGTGCTCAGGCACCTGGTGTCTAATAGGTGGGACTAAGTTCCTCGCCCCGT |
| | | | | ACTCCTGCCAGATTCTCAGGCTCCGCTTGGAGGCAAGGCTGTTCTATGGTACAGCAGCCTAAGGTACA |
| | | | | GCCAGAGGATGAGGCAGAATATTACTGTCTGTTCTATGGTACAGCAACCGCTGGGTGTTCGGTGAG |
| | | | | GAACCAAACTGACTGTCCTA |
| 259. | CD33 AH3 HL x F12Q HL | artificial | aa | QVQLVQSGAEVKKPGESVKVSCKASGYTFTNYGMNWVRQAPGQGLEWMGWINTYTGEPTYADDFK |
| | | | | GRVTMSSDTSTSTAYLEINSLRSDDTAIYYCARWSWSDGYYVIPDYWGQGTTVTVSSggggsggg |
| | | | | ggsgggsDIVMTQSPDSLTVLGERTTINCKSSQSVLLDSKNKNSLAWYQQKPGQPPKLLLSWAS |
| | | | | TRESGIPDRPSGSGSGTDFTLTIDSLQPEDSATTYCQQSAHFPITFGQGTRLEIKSGGGSEVQL |
| | | | | VESGGGLVQPGGSLKLSCAASGFTFNSYAMNWVRQAPGKGLEWVARIRSKYNNYATYADSVKGR |
| | | | | FTISRDDSKNTAYLQMNNLKTEDTAVYYCVRHGNFGNSVVSWWAYWGQGTLVTVSSGGGGSGGGG |
| | | | | SGGGGSQTVVTQEPSLTVSPGGTVLTCGSSTGAVTSGNYPNWVQQKPGQAPRGLIGGTKFLAPG |
| | | | | TPARPSGSLLGGKAALTLSGVQPEDEAEFYCVLWYSNRWVFGGGTKLTVL |
| 260. | CD33 AH3 HL x F12Q HL | artificial | nt | CAGGTGCAGCTGGTGCAGTCTGGAGCTGAGGTGAAAAAGCCTGGAGAGTCAGTCAAGGTCTCCTG |
| | | | | CAAGGCTAGCGGATACACCTTCACAAACTATGGAATGAACTGGGTGCGACAGGCTCCAGGACAGG |
| | | | | GTTTAGAGTGGATGGGCTGGATAAACACTTACACAGGTGAGCCAACATATGCTGATGACTTCAAG |
| | | | | GGACGGGTTACCATGTCTTCGGACACATCCACCAGCACGGCCTATTTGGAGATCAACAGCCTCAG |
| | | | | AAGTGATGACACGGCTATATATTACTGTGCGCGATGGAGTTGGAGTGATGGTTACTACGTTTACT |
| | | | | TTGACTACTGGGGCCAAGGCACCACTGTCACCGTCTCCTCAGGTGGTGGTGGTTCTGGCGGCGGC |
| | | | | GGCTCCGGTGGTGGTGGTTCTCAGACTGTGATGACACAGTCCAGAGTGTTTTAGACAGTCCAAGATC |
| | | | | GGGCGAGAGGACCACCATCAACTGCAAGTCCAGCCAGAGTGTTTTAGACAGTAAGAATAAGA |
| | | | | ACTCCTTAGCTTGGTACCAGCAGAAACCAGGACAGCCTCCTAAATTACTCTTTCTGGGCATCT |
| | | | | ACGCGGGAATCCGGACCCCTGACGGTTCAGTGCAGCAGCGGATCTGGGACAGATTTCACTCTCAC |
| | | | | TATTGACAGCCTGCAGCCTGAAGATTCTGCAACTTACTATTGTCAACAGTCTGCCCACTTCCCGA |
| | | | | TCACCTTTGGCCAAGGGACCAGACTGGAGATTAAATCCGGAGGTGGGTCCGAGGTGCAGCTG |
| | | | | GTCGAGTCTGGAGGAGGATTGGTGCAGCCTGGAGGGTCCCTGAAACTCTCATGTGCAGCCTCTGG |
| | | | | ATTCACCTTCAATAGTTACGCCATGAACTGGGTCCGCCAGGCTCCAGGAAAGGGTTTGGAATGG |
| | | | | TTGCTCGCATAAGAAGTAAATATAATAATTATGCCAACATATATATGCGATTCAGTGAAGGACAGG |
| | | | | TTCACCATCTCCAGAGATGATTCAAAAAACACTGCTATTCTTGGTAATGCTACTGTTTCTGGTGG |
| | | | | GGAACTGCCGTGTACTACTGTGTGAGACATGGAACTTCGGTAATGACTACTGTTTCTGGTGGG |
| | | | | CTTACTGGGGCCAAGGGACTCTGGTCACCGTCTCCTCAGGTGGTGGTGGTTCTGGCGGCGGC |
| | | | | TCCGGTGGTGGTGGTTCTCAGACTGTTGTGACTCAGGAACCCTCACTCACTGTATCACCTGTTG |
| | | | | AACAGTCACTCACTTGTCTCAGGCACCTGGTGTCTAATAGGTGGACTAAGTTCCTCGCCAACTGG |
| | | | | TCCAACAAAAACAGGTCAGGCACCTGCCAGGCTCCGCTGTTGGAGGCAAGGCTGCCCTCACCGCTGGGCTACCCCAAACTGG |
| | | | | ACTCCTGCCAGATTCTCAGGCTCCGCTTGGAGGCAAGGCTGTTCTATGGTACAGCAGCCCTAAGGTACA |
| | | | | GCCAGAGGATGAGGCAGAATATTACTGTCTGTTCTATGGTACAGCAACCGCTGGGTGTTCGGTGAG |
| | | | | GAACCAAACTGACTGTCCTA |
| 261. | CD33 AH3 HL x I2C HL | artificial | aa | QVQLVQSGAEVKKPGESVKVSCKASGYTFTNYGMNWVRQAPGQGLEWMGWINTYTGEPTYADDFK |
| | | | | GRVTMSSDTSTSTAYLEINSLRSDDTAIYYCARWSWSDGYYVIPDYWGQGTTVTVSSggggsggg |

| SEQ ID NO. | DESIGNATION | SOURCE | TYPE | SEQUENCE |
|---|---|---|---|---|
| | | | | gsgggsDIVMTQSPDSLTVSLGERTTINCKSSQSVLDSSKNKNSLAWYQQKPGQPPKLLLSWAS |
| | | | | TRESGIPDRPSGSGTDFTLTIDSLQPEDSATYYCQQSAHFPITFGQGTRLEIKSGGGGSEVQL |
| | | | | VESGGGLVQPGGSLKLSCAASGFTFNKYAMNWVRQAPGKGLEWVARIRSKYNNYATYYADSVKDR |
| | | | | FTISRDDSKNTAYLQMNNLKTEDTAVYYCVRHGNFGNSYISYWAYWGQGTLVTVSSGGGGSGGGG |
| | | | | SGGGGSQTVTQEPSLTVSPGGTVTLTCGSSTGAVTSGNYPNWVQQKPGQAPRGLIGGTKFLAPG |
| | | | | TPARFSGSLLGGKAALTLSGVQPEDEAEYYCVLWYSNRWVFGGGTKLTVL |
| 262. | CD33 AH3 HL × I2C HL | artificial | nt | CAAGTGCAGCTGGTGCAGTCTGGAGCTGAGGTGAAAAAGCCTGGGGCCTCAGTCAAGGTCTCCTG |
| | | | | CAAGGCTAGCGGGTATACCTTCACAAACTATGGAATGAACTGGGTGCGACAGGCTCCAGGACAGG |
| | | | | GTTTAGAGTGGATGGGCTGGATAAACACCTACTGGAGACCACTGCCTATTTGGAAGTTACTATCAAG |
| | | | | GGACGGGTTACCATGTCTTCGGACATATTACTGTGCGCGTGGAGTTGGATGGTTACTACGTTTACT |
| | | | | AAGTGATGACACGGCTATATATTACTGTGCGCGTGGAGTTGGATGGTTACTACGTTTACT |
| | | | | TGACTACTGGGGCCAAGGGACCACTAGTCATCGAAGTCCCTCCCAGGCTGTGTTCTCT |
| | | | | GGCTCCGGTGTGGGTGTTCACCATCTGTGTGACTGGGACCCTCCTCCAGGACACAGTCTGTCTCT |
| | | | | GGGCGAGGAGGACCACCATCCAAGTCCAAGCTCCAGCACAGTGTTTAGACAGCTCCAAGAATAAGA |
| | | | | ACTCCTTAGCTTGCTACCAGCAGAAACAGGACAGCCTCCTAAATTACTCCTTTCTGGGACATCT |
| | | | | ACGCGGAATCCGGATCCTGACCCTGCAGTCAGTGCGACGGGCTGGGACAGATTCACTCTCAC |
| | | | | TATTGACAGCTGCAGCCTGCAACTTCTGCAACTATCTGTCAAGCTGCTGCACTGCACCTCCCGA |
| | | | | TCACCTTTGGCCAAGGACACGACTGGAGATTAAATCCGGAGGTGTGCTCACGCCTCAGCTG |
| | | | | GTCCAGATCTGGAAGAAGGATTGGTGCAGCTGGAACTGGGTCCGGCAGGCTCATTGAAACTCTCATGTCAGCCTCTG |
| | | | | ATTCAACCTTCAATAAGTACGCCATGAACTGGGTGCCGCAGGCTCCAGGAAAGGGTTTGAATGG |
| | | | | TTGCTCGCATAAGAAGTAAATATATAATATATGCCGATTCAGTAGAAGACAGG |
| | | | | TTCACCATCTCCAGAGATGATTCAAAAAACACTGCCTATCTACAGATGAACAACTGAAAACTGA |
| | | | | GGACACTGCCGTGTACTACTGTGTGAGACATGGAACTTCGGTAATAGCTACTATATCCTACTGGG |
| | | | | CTTACTGGGGCCAAGGGACCCTGGTCACCGTCTCGAGTGGTGGTGGTTCTGGCGGCGGCGGC |
| | | | | TCCGGTGTGGTGTTCTCAGAACTCTGGTGACTCAGGAACCTTCACTCACCGTATCACCTGTGG |
| | | | | AACAGTCACACTCACTTGTGTCTCAGGCACCCTGTGTCTAATAGGTGGACCAAGGCTGGT |
| | | | | TCCAACAAAACAGGTCAGGCCCAGATTCTCAGGCTCAGCATTCCCCTCACCCTCAGGGGTAACA |
| | | | | ACTCCTGCCAGATTGAGGCAGAGATATTACTGTGTTCATGGTACAGACACCGCTGGGTTCGGTGGAG |
| | | | | GAACCAAACTGACTGTCCTA |
| 263. | CD33 AF5 HL × H2C HL | artificial | aa | QVQLVQSGAEVKKPGASVKVSCKASGYTFTNYGMNWVKQAPGQGLKWMGWINTYTGEPTYADDFK |
| | | | | GRVTMTSDTSTSTAYLELHNLRSDDTAVYYCARMSWSDGYYVFDYWGQGTTVTVSSggggsggggg |
| | | | | gsggggsDIVMTQSPDSLTVSLGERTTINCKSSQSVLDSSKNKNSLAWYQQKPGQPPKLLLSWAS |
| | | | | TRESGIPDRPSGSGTDFTLTIDSLQPEDSATYYCQQSAHFPITFGQGTRLEIKSGGGGSEVQL |
| | | | | VESGGGLVQPGGSLKLSCAASGFTFNKYAMNWVRQAPGKGLEWVARIRSKYNNYATYYADSVKDR |
| | | | | FTISRDDSKNTAYLQMNNLKTEDTAVYYCVRHGNFGNSYISYWAYWGQGTLVTVSSGGGGSGGGG |
| | | | | SGGGGSQTVTQEPSLTVSPGGTVTLTCGSSTGAVTSGYYPNWVQQKPGQAPRGLIGGTKFLAPG |
| | | | | TPARFSGSLLGGKAALTLSGVQPEDEAEYYCALWYSNRWVFGGGTKLTVL |
| 264. | CD33 AF5 HL × H2C HL | artificial | nt | CAGGTGCAGCTGGTGCAGTCTGGAGCTGAGGTGAAGAAGCCTGGGGCCTCAGTCAAGGTCTCCTG |
| | | | | CAAGGCTAGCGGGTATACCTTCACAAACTATGGAATGAACTGGGTACGACAGGCTCCAGGACAGG |
| | | | | GTTTAAAGTGGATGGGCTGGATAAACACCTACTACTGGAGAGCCACTGCCTATGCTGATGACTTCAAG |
| | | | | GGACGGGTTACCATGACCAGCGACACTTCGACATCCACAGCCTATCTGGAGCTGCACAACCTCAG |
| | | | | AAGTGATGACACGGCTGTATATTACTGTGCGCGTATGAGTTGGAGTGATGGTTACTACGTTTACT |
| | | | | TTGACTACTGGGGCCAAGGGACCACTAGTCACCGTCTCCTCAGGTGGTGGTTCTGGCGGCGGCGGC |
| | | | | GGCTCCGGTGTGGTGTTCTGACATGGTGATGACTCAGGAACACAGTCCCTCCAGCTCCTGACTGTCTCT |
| | | | | GGGCGAGGAGGACCACCATCCAAGTCCAAGCAGGACAGCCTCCTAAATTACTCCTTTCTGGGACATCT |
| | | | | ACGCGGAATCCGGATCCCTGACCCTGCAGTCAGTGCAGCCGGGTCTGCAGCAGATTTCACTCTCAC |

| SEQ ID NO. | DESIGNATION | SOURCE | TYPE | SEQUENCE |
|---|---|---|---|---|
| | | | | TATTGACAGGCTGCAGCCTGAAGATTCTGCAACTTACTATTGTCAACAGTCTGCCCACTTCCCGA |
| | | | | TCACCTTTGGCCAAGGAGCACGACTGGTGACTGTGAGCTGGAGGTGCAACCTCATGTGCAGCCTCTG |
| | | | | GTCGAGTCTGGAGGAGGATTGGTGCAGCCTGGAGGGTCCGCCAGGCTCATTGAACTGTCAGCCTCTGG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAAATATAATAATTATGCAACATATTATGCGGATTCAGTGAAGAGACAGG |
| | | | | TTCACCATCTCCAGAGATGATTCAAAAAACACTGCCTATCTACAAAGAACTGCTGTATATCCTACTGGG |
| | | | | GGAACTGCCGTGTACTACTGTGTGAGACATGGAACTTCGGTAATGACTGGTGTTCTGGCGCGGCC |
| | | | | CTTACTGGGCCAAGGAGACTCGGTCACCGTCTCCTCAGGTGGTGGTGGTTCTGGCGGCGGCGGC |
| | | | | TCCGGTGGTGGTGGATCTGTTCTCAGACTGTTGACTCAGGAACCTCACTGTCCTCAGGTACTGGG |
| | | | | AACAGTCACACTCACTTGTGCTCAGGCCTCAGGCTACCTGAGCCTGTCTATGTACTGGTACCAAACTGG |
| | | | | TCCAACAAAAAACCAGGCTCAGGCCCTGTGTCTTGGAGGCAAGGCTGCCCTCACCCTCTCAGGGGTACA |
| | | | | ACTCCTGCCAGATTCTCAGGCTCTGCCTTGGAGACTGGGCTGAGCAGCAGTCGCAACGATTGAGTCTGG |
| | | | | GCCAGAGGATGAGGCAGAATATTACTGTGTCTTATGGTACAGCAACCGCTGGGTTCGTGGAG |
| | | | | GAACCAAACTGACTGTCCTA |
| 265. | CD33 AF5 HL x F12Q HL | artificial | aa | QVQLVQSGAEVKKPGASVKVSCKASGYTFTNYGMNWVKQAPGQGLKWMGWINTYTGEPTYADDFK |
| | | | | GRVTMTSDTSTSTAYLELHNLRSDDTAVYYCARWSWSDGYYVYFDYWGQGTTVTVSSggggsggg |
| | | | | gsgggsDIVMTQSPDSLTVSLGERTTINCKSSQSVLLDSKNKNSLAWYQQKPGQPPKLLLSWAS |
| | | | | TRESGIPDRPSGSGSGTDFTLTIDSLQPEDSATYYCQQSAHPPITFGQGTRLEIKSGGGSEVQL |
| | | | | VESGGGLVQPGGSLKLSCAASGFTFNSYAMNWVRQAPGKGLEWVARIRSKYNNYATYYADSVKGR |
| | | | | FTISRDDSKNTAYLQMNNLKTEDTAVYYCVRHGNFGNSYVSWAYWGQGTLVTVSSGGGGSGGGG |
| | | | | SGGGGSQTVVTQEPSLTVSPGGTVTLTCGSSTGAVTSGNYPNWVQQKPGQAPRGLIGGTKFLAPG |
| | | | | TPARPSGSLLGGKAALTLSGVQPEDEAEYYCVLWYSNRWVFGGGTKLTVL |
| 266. | CD33 AF5 HL x F12Q HL | artificial | nt | CAGGTGCAGCTGGTGCAGTCTGGAGCTGAGGTGAAGAAGCCTGGAGCCTCAGTCAAGGTCTCCTG |
| | | | | CAAGGCTAGCGGATACACCTTCACAAACTATGGAATGAACTGGGTGAAGCAGGCTCCAGGACAGG |
| | | | | GTTTAAAGTGGATGGGCTGGATAAACACCTACACTGGAGAGCCAACATATGCTGATGACTTCAAG |
| | | | | GGACGGGTTACCATGACTTCGGATACATCCACAGCAGCCTATTTGGAACTCCACAACCTGAG |
| | | | | AAGTGATGACAGCTGGTATATATTACTGTGCGCGACAGTTGGAGTTGATGGTTACTACGTTTACT |
| | | | | TTGACTACTGGGGCCAAGGCACCACTGTCACCGTCTCCTCAGGTGGCTGGTGGTTCTGGCGGCGGC |
| | | | | GGCTCCGGTGGTGGTGGATCTGACATCGTGATGACACAGTCTCCAGACTCTCTGACTGTGTCT |
| | | | | GGGCGAGAGACCACCATCAACTGCAAGTCCAGCCAGAGTGTTTTAGACAGTCCAAGAATAAGA |
| | | | | ACTCCTTAGCTTGGTACCAGCAGAAACCAGGACAGCCTCCTAAATTACTCATTTCTTGGGCATCT |
| | | | | ACCCGGGAATCCGGAGTCCCTGACCGATTCAGTGGCAGCGGGTCTGGGACAGATTTCACTCTCAC |
| | | | | TATTGACAGCCTGCAGCCTGAAGATTCTGCAACTTACTATTGTCAACAGTCTGCCCACTTCCCGA |
| | | | | TCACCTTTGGCCAAGGGACCAGACTGGAGATTAAAATCCGGTCCGGAGGTGGCCCAGGTCAGCTG |
| | | | | GTCGAGTCTGGAGGAGGACTGGTGCAGCCTGGAGGGTCCCTGAAACTCTCATGTGCAGCCTCTGG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAAATATAATAATTATGCAACATATTATGCGGATTCAGTGAAGGCAGG |
| | | | | TTCACCATCTCCAGAGATGATTCAAAAAACACTGCCTATCTGCAGATGAACTGCTGTTTCTGGTGG |
| | | | | GGAACTGCCGTGTACTACTGTGTGAGACATGGAACTTCGGTAATGACTGGTGTTCTGGCGCGGCC |
| | | | | CTTTACTGGGCCAAGGAGACTCGGTCACCGTCTCCTCAGGTGGTGGTGGTTCTGGCGGCGGCGGC |
| | | | | TCCGGTGGTGGTGGATCTCAGACTGTTGTGACTCAGGAACCTCACTGTCCTCAGGTACTGGG |
| | | | | AACAGTCACACTCACTTGTGCTCAGGCCTCAGGCTACCTGCCAACTGGCAATCGCAACTGG |
| | | | | TCCAACAAAAAACCAGGCTCAGGCCCTGTGTCTTGGAGGCAAGGCTGCCCTCACCCTCTCAGGGGTACA |
| | | | | ACTCCTGCCAGATTCTCAGGCTCTGCCTTGGAGACTGGGCTGAGCAGCAGTCGCAACGATTGAGTCTGG |
| | | | | GCCAGAGGATGAGGCAGAATATTACTGTGTCTTATGGTACAGCAACCGCTGGGTTCGTGGAG |
| | | | | GAACCAAACTGACTGTCCTA |
| 267. | CD33 AF5 HL x I2C HL | artificial | aa | QVQLVQSGAEVKKPGASVKVSCKASGYTFTNYGMNWVKQAPGQGLKWMGWINTYTGEPTYADDFK |
| | | | | GRVTMTSDTSTSTAYLELHNLRSDDTAVYYCARWSWSDGYYVYFDYWGQGTTVTVSSggggsggg |

| SEQ ID NO. | DESIGNATION | SOURCE | TYPE | SEQUENCE |
|---|---|---|---|---|
| | | | | gsgggsDIVMTQSPDSLTVSLGERTTINCKSSQSVLDSSKNKNSLAWYQQKPGQPPKLLLSWAS TRESGIPDRPSGSGSGTDFTLTIDSLQPEDSATYYCQQSAHFPITFGQGTRLEIKSGGGSEVQL VESGGGLVQPGGSLKLSCAASGFTFNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGYYPNWVQQKPGQAPRGLIGGTKFLAPG TPARFSGSLLGGKAALTLSGVQPEDEAEYYCVLWYSNRWVFGGGTKLTVL |
| 268. | CD33 AF5 HL x I2C HL | artificial | nt | CAGGTGCAGCTGGTGCAGTCTGGAGCTGAGGTGAAGAAGCCTGGAGCCTCAGTCAAGGTCTCCTG CAAGGCTAGCGGGTATACCTTCACAAACATATGGAATGAACTGGGTGAAGCAGGCTCCAGGACAG GTTTAAAGTGGATGGGCTGGATAAACACCTACTCTGGAGAGCCAACAATAATCCGAACCTCAAG GGACGGGTTACCATGACCGACTTCTGATATATTACTGTGCCGCGTGGAGTTGATGGTATACGTTTACT TGACTACTGGGCCAAGGCACTACGGTCACCGTCTCCTCAGGTGGTGGTGCTTCTGGCGGCGGC GGCTCCGGTGGTGGTGGATCTGATGACACAGTCTCCAGATGACACTCCCTGACTGTCTCT GGGCGAGAGGACCACCATCAACTGCAAGTCCAGCCAGAGTGTTTTAGACAGCTCCAAGAATAAGA ACTCCTTAGCTTGCTACCAGCAGAAACCAGGACAGCCTCCTAAATTACTCCTTTCTGGGCATCT ACGGGGAATCCGGATCCCCTGACCCGATTCAGTGCAGTGGCAGTGGGTCTGGGACAGATTTCACTCTCAC TATTGACAGCCTGCACCCTGAAGATTCTGACAACTTATGTTCAACAGTGTATGCCACTCCCCA TCACCTTTCGGCCAAGGGACAAGACTGGAGATTAATCCGAGGTGTGCCTCCGAGGTGCAGCTG GTCGAGTCTGGAGGAGGATTGGTGCAGCCTGGCAGGTCCGCAGGCTCATTGAAACTTCATGTGCAGCCTCTGG ATTCACCTTCAATAAGTACGCCATGAACTGGGTCCGCCAGGCTCCAGGGAAGGGGTTTGAATGG TTGCTCGCATAAGAAGTAATAAATAAATATGCAGATTACATATATGTCAGTGAAGACAGG TTCACCATCTCCAGAGATGATTCAAAAAACACTGCCTATCTGCAAATGAACAACTTGAAAACTGA GGACACTGCCGTGTACTACTGTGTGAGACATGGAACTTCGGTATAGACTACTATATCTACTGGG CTTACTGGGGCCAAGGGACTCTGGTCACCGTCTCAGGTGGTGGTGGTTCAGGAACCTTCACTCCTGG TCCGGTGGTGGTGTTCAGAGACTCTCCAGGACCCTCACTGTGACAGTCTCCTCACCTGTGG AACAGTCACACTCACTTGTCGCTCATGGACCATGTGACATCTGGGCCAACATCGGCAACTGGG TCCAACAAAACAGGCGAGGCCTCCCCTGCTTGAAGACAAGGCTCCCTCCACCCTCAGGGGTACA ACTCCTTAGCTTGCCCAGATTCTCAGCTCCTGTGTACAAGGCTCTGCCCAACCCGCTGGGTTCGGTGAG GCCAGAGGATGAGGCAGATATTACTGTGTTCTATGGTACAGCACGCTGGTTCGGTGGAG GAACCAAACTGACTGTCCTA |
| 269. | CD33 A08 HL x H2C HL | artificial | aa | QVQLVQSGAEVKKPGESVKVSCKASGYTFTNYGMNWVKQAPGQGLKWMGWINTYTGEPTYADDFK GRVTMTDTSTSTAYMEIRNLRNDDTAVYYCARMsWSDGYYVYFDYWGQGTTVTVSSggggsggg gsgggsDIVMTQSPDSLTVSLGERTTINCKSSQSVLDSSKNKNSLAWYQQKPGQPPKLLLSWAS TRESGIPDRPSGSGSGTDFTLTIDSLQPEDSATYYCQQSAHFPITFGQGTRLEIKSGGGSEVQL VESGGGLVQPGGSLKLSCAASGFTFNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGYYPNWVQQKPGQAPRGLIGGTKFLAPG TPARFSGSLLGGKAALTLSGVQPEDEAEYYCALWYSNRWVFGGGTKLTVL |
| 270. | CD33 AC8 HL x H2C HL | artificial | nt | CAGGTGCAGCTGGTGCAGTCTGGAGCTGAGGTGAAGAAGCCTGGAGAGTCTCAGTCAAGGTCTCCTG CAAGGCTAGCGGGTATACCTTCACAAACATATGGAATGAACTGGGTAAGCAGGCTCCAGGACAG GTTTAAAGTGGATGGGCTGGATAAACACCTACTCTGGAGAGCCAACAATAATCCGAACCTCAAG GACGGGTTACCATGACTGACTACGGATACCTCTACCAGCACTGCCTATATGGAAATCCGCAACCTCAG AAATGATGACAGCACGGCTGTATATTACTGTGCCGCGTGGAGTTGATGGTATACGTTTACT TTGACTACTGGGGCCAAGGCACTACGGTCACCGTCTCCTCAGGTGGTGGTGCTTCTGGCGGCGGC GGCTCCGGTGGTGGTGGATCTGATGACACAGTCTCCAGACTCTCCAGCTGTCTCT GGGCGAGAGGACCACCATCAACTGCAAGTCCAGCCAGAGTGTTTTAGACAGCTCCAAGAATAAGA ACTCCTTAGCTTGCTACCAGCAGAAACCAGGACAGCCTCCTAAATTACTCCTTTCTGGGCATCT ACGCGGGAATCCGGATCCCCTGACCCGATTCAGTGCAGTGGCAGTGGGTCTGGGACAGATTTCACTCTCAC |

| SEQ ID NO. | DESIGNATION | SOURCE | TYPE | SEQUENCE |
|---|---|---|---|---|
| | | | | TATTGACAGGCTGCAGCCTGAAGATTCTGCAACTTACTATTGTCAACAGTCTGCCACTTCCCGA |
| | | | | TCACCTTTGGCCAAGGAACAGACGACTGGAGATTAAATCCGGAGGTGGTGGCTCCAGGTGCAGCTG |
| | | | | GTCGAGTCTGGAGGAGGATTGGTGCAGCCTGGAGGGTCCGCCATGAACTCTCATGTGCAGCCTCTG |
| | | | | ATTCACCTTCAATAAGTACGCCATGAACTGGATTCGCCAGGCTCCAGGAAAGGGTTTGGAATGGG |
| | | | | TTGCTCGCATAAGAAGTAAATATAATTATGCAACACATATTATGCCGATTCAGTGAAGACAGG |
| | | | | TTCACCATCTCCAGAGATGATTCAAAAAACACTGCTATTACAAATGAACAACTGAAAACTGA |
| | | | | GGAACTGCCGTGTACTACTGTGTGAGACATGGAACTTCGGTAATGGTGGTGGTGGTACTATCTACTGGG |
| | | | | CTTACTGGGGCCAAGGACTCTGGTCACCGTCTCCAGCCAGGGTGTTACACTGGCTACTCACCTGTGG |
| | | | | TCCGGTGGTGGTGGTTCTCAGACTGTTGTGACTCAGGAACCTTCACTCGTCTCCGGTATCACCTGTGG |
| | | | | AACAGTCACACTCACTTGTGCTCAGGACCTCAGGTCTTAATAGGTGGACTAAGTTCCTCGCCCCGT |
| | | | | ACTCCTGCCAGATTCTCAGGCTCCGCTTGGAGGCAAGGCTGCCCTCACCCTCAGGGGTACA |
| | | | | GCCAGAGGATGAGGCAGAATATTACTGTGTCTTATGGTACAGCAGCGCTGGGTGTTCGGTGAG |
| | | | | GAACCAAACTGACTGTCCTA |
| 271. | CD33 AC8 HL × F12Q HL | artificial | aa | QVQLVQSGAEVKKPGESVKVSCKASGYTFTNYGMNWVKQAPGQGLKWMGWINTYTGEPTYADDFK |
| | | | | GRVTMTTDTSTSTAYMEIRNLRNDDTAVYYCARWSWSDGYYVIPFDYWGQGTTVTVSSggggsggg |
| | | | | gsggggsDIVMTQSPDSLTVLGERTTINCKSSQSVLLSDSSKNKNSLAWYQQKPGQPPKLLLSWAS |
| | | | | TRESGIPDRFSGSGSGTDFTLTIDSLQPEDSATTYCQQSAHFPITFPGQGTRLEIKSGGGSEVQL |
| | | | | VESGGGLVQPGGSLKLSCAASGFTNSYAMNWVRQAPGKGLEWVARIRSKYNNYATYADSVKGR |
| | | | | FTISRDDSKNTAYLQMNNLKTEDTAVYYCVRHGNFGNSVVSWWAYWGQGTLVTVSSGGGGSGGGG |
| | | | | SGGGGSQTVVTQEPSLTVSPGGTVLTCGSSTGAVTSGNYPNWVQQKPGQAPRGLIGGTKFLAPG |
| | | | | TPARPSGSLLGGKAALTLSGVQPEDEAEYYCVLWYSNRWVFGGGTKLTVL |
| 272. | CD33 AC8 HL × F12Q HL | artificial | nt | CAGGTGCAGCTGGTGCAGTCTGGAGCTGGAGGTGAAGAAGCCTGGAGAGTCAGTCAAGTCTCCTG |
| | | | | CAAGGCTAGCGGATATACCTTCACAAACTATGGAATGAACTGGGTGAAGCAGGCTCCAGGACAGG |
| | | | | GTTTAAAGTGGATGGCTGGATATAAACACCTACACTGGAGAGCCAACATATGCTGATGACTTCAAG |
| | | | | GGACGGGTTACCATGACTACGACTGTAGACACCTCTACCAGCACTGGAGTTGGCCTCAACCTCAG |
| | | | | AAATGATGACAGCGCTGTATATTACTGTGCGCGTGAGTGATGGTTATACGTTACT |
| | | | | TTGACTACTGGGGCCAAGGACCAGTGGAGTGGTTCTGCGCGCC |
| | | | | GGCTCCAGGTGGTGGTGGTTCAGATCGTGATGACAGTGACACAGTCTCCAGACTCCTGTGTCT |
| | | | | GGGCGAGAGGACCACCATCAACTGCAAGTCCAGCCAGAGTGTTTTAGACAGCTCCAAGAATAAGA |
| | | | | ACTCCTTAGCTTGGTACCAGCAGAAACCAGGACAGCCTCCTAAATTACTCTTTCTGGGCATCT |
| | | | | ACGGGGAATCCGGATCCCTGACCGATTCAGTGGCAGCTCCAGGACAGATTTCACTCTCAC |
| | | | | TATTGACAGCCTGCAGCCTGAAGATTCTGCAACTTACTATTGTCAACAGTCTGCCACTTCCCGA |
| | | | | TCACCTTTGGCCAAGGAACAGACGGATTGGAGATTAAATCCGGAGGTGGTGGCTCCAGGTGCAGCTG |
| | | | | GTCGAGTCTGGAGGAGGATTGGTGCAGCCTGGAGGGTCCGCCATGAACTCTCATGTGCAGCCTCTG |
| | | | | ATTCACCTTCAATAAGTACGCCATGAACTGGATTCGCCAGGCTCCAGGAAAGGGTTTGGAATGGG |
| | | | | TTGCTCGCATAAGAAGTAAATATAATTATGCAACACATATTATGCCGATTCAGTGAAGACAGG |
| | | | | TTCACCATCTCCAGAGATGATTCAAAAAACACTGCTATTACAAATGAACAACTGAAAACTGA |
| | | | | GGAACTGCCGTGTACTACTGTGTGAGACATGGAACTTCGGTAATGGTGGTGGTGGTACTTCTGTGGG |
| | | | | CTTACTGGGGCCAAGGACTCTGGTCACCGTCTCCAGCAGTGGTGGTTACACTGGCTACTCACCTGTGG |
| | | | | TCCGGTGGTGGTGGTTCTCAGACTGTTGTGACTCAGGAACCTTCACTCGTCTCCGGTATCACCTGTGG |
| | | | | AACAGTCACACTCACTTGTGCTCAGGACCTCAGGTCTTAATAGGTGGACTAAGTTCCTCGCCCCGT |
| | | | | ACTCCTGCCAGATTCTCAGGCTCCGCTTGGAGGCAAGGCTGCCCTCACCCTCAGGGGTACA |
| | | | | GCCAGAGGATGAGGCAGAATATTACTGTGTCTTATGGTACAGCAGCGCTGGGTGTTCGGTGAG |
| | | | | GAACCAAACTGACTGTCCTA |
| 273. | CD33 AC8 HL × I2C HL | artificial | aa | QVQLVQSGAEVKKPGESVKVSCKASGYTFTNYGMNWVKQAPGQGLKWMGWINTYTGEPTYADDFK |
| | | | | GRVTMTTDTSTSTAYMEIRNLRNDDTAVYYCARWSWSDGYYVIPFDYWGQGTTVTVSSggggsggg |

-continued

| SEQ ID NO. | DESIGNATION | SOURCE | TYPE | SEQUENCE |
|---|---|---|---|---|
| | | | | gsgggsDIVMTQSPDSLTVSLGERTTINCKSSQSVLDSSKNKNSLAWYQQKPGQPPKLLLSWAS<br>TRESGIPDRPSGSGTDFTLTIDSLQPEDSATYYCQQSAHFPITFGQGTRLEIKSGGGSEVQL<br>VESGGGLVQPGGSLKLSCAASGFTFNKYAMNWVRQAPGKGLEWVARIRSKYNNYATYYADSVKDR<br>FTISRDDSKNTAYLQMNNLKTEDTAVYYCVRHGNFGNSYISYWAYWGQGTLVTVSSGGGGSGGGG<br>SGGGGSQTVVTQEPSLTVSPGGTVLTCGSSTGAVTSGNYPNWVQQKPGQAPRGLIGGTKFLAPG<br>TPARFSGSLLGGKAALTLSGVQPEDEAEYYCVLWYSNRWVFGGGTKLTVL |
| 274. | CD33 AC8 HL x I2C HL | artificial | nt | CAGGTGCAGCTGGTGCAGTCTGGAGCTGAGGTGAAGAAGCCTGGAGAGTCCAGTCAAGGTTCCTG<br>CAAGCAGTGCGGGTATACCTTCACAAACTATGGAATGAACTGGGTGAAGCAGGCTCCAGGACAGG<br>GTTTAAAGTGGATGGCTGATAAAACCACCTCACTGGAGAGCCAACATATGCTGATGACTTCAAG<br>GGACGGGTTACCATGACTAGCGATACATCTCACCAGCACTGCCTATATGGAAATCCGAACCTCAG<br>AAATGATGACACGGCTGTATATTACTGTGCGCGTCGTGGAGTTGGAGTTGATGGTTACTACGTTTACT<br>TTGACTACTGGGGCCAAGGCACTACGGTCACCGTCTCCAGGTGGTGTGGTTCTGGCGGCGG<br>GGCTCCGGTGGTGGTTCTGACATCGTGATGACACAGTCTCCAGGTGTTTAGACAGCTCCAAGATCTCT<br>GGGCGAGAGGACCACCATCAACTGCAAGTCCAGCCAGAGTGTTTTAGACAGCTCCAAGAATAAGA<br>ACTCCTTAGCTTGGTACCAGCAGAAACCAGGACAGCCTCCTAAATTACTCCTTTCTGGCATCT<br>ACGTGGGAATCCGGGATCCTGCAACTTCAGTGGCAGCGGGTCTGGGACAGATTTCACTCTCAC<br>TATTGACAGCCTGCACCCTGAAGATTCTGCAACTTACTATTGTCAACAGAGTTATGCCCACTTCCCGA<br>TCACCTTTGGCCAAGGACACGACTGGAGATTAAATCCGGAGGTGTGCCTCCGAGGTGCAGCTG<br>GTCGAGTCTGGAGGAGGCATTGGTGCAGCCTGGAGGGTCCGGCAGGTCATTGAAACTTCATGTGCAGCCTCTG<br>ATTCACCTTCAATAAGTACGCCATGAACTGGGTCCGCCAGGCTCCAGGAAAGGGTTTGAATGG<br>TTGCTCGCATAAGAAGTAATATAATATATGCCGATTCAGTGAAGACAGG<br>TTCACCATCTCCAGAGATGATTCAAAAAACACTGCCTATCACACAGATGAACAACTGAAAACTGA<br>GGACACTGCCGTGTACTACTGTGTGAGACATGGGAACTTCGGTAATAGCTACATATCCTACTGGG<br>CTTACTGGGGCCAAGGGACCACGGTCACCGTCTCCAGTGGTGGTGGTGGTTCTGGCGGCGGC<br>TCCGGTGGTGGTGGTTCTCAGACTGTTGTGACCCAGGAACCTTCACTCTGCTATCACCTGTGG<br>AACAGTCACACTCACTGTGGTCAGGCACCGTCAGGGTCTAATAGGTGGACAAGGCTGCCCTCACCCTCAGGGTACA<br>TCCAACAAAAACCAGGTCAGGCACCGTCAGGCTCTAATAGGTGGACAAGGCTGCCCTCACCCTCAGGGTACA<br>GCCAGAGGATGAGGCAGAGATTATTACTGTGTTCTATGGTACAGCAGCCGCTGGGTTCGGTGGAG<br>GAACCAAACTGACTGTCCTA |
| 275. | CD33 AH11 HL x H2C HL | artificial | aa | QVQLVQSGAEVKKPGESVKVSCKASGYTFTNYGMNWVKQAPGQGLKWMGWINTYTGEPTYADDFK<br>GRVTMTSDTSTSTAYMEISSLRSDDTAVYYCARMSWSDGYYVFDYWGQGTTVTVSSgggsggg<br>gsgggsDIVMTQSPDSLTVSLGERTTINCKSSQSVLDSSKNKNSLAWYQQKPGQPPKLLLSWAS<br>TRESGIPDRPSGSGTDFTLTIDSLQPEDSATYYCQQSAHFPITFGQGTRLEIKSGGGGSEVQL<br>VESGGGLVQPGGSLKLSCAASGFTFNKYAMNWVRQAPGKGLEWVARIRSKYNNYATYYADSVKDR<br>FTISRDDSKNTAYLQMNNLKTEDTAVYYCVRHGNFGNSYISYWAYWGQGTLVTVSSGGGGSGGGG<br>SGGGGSQTVVTQEPSLTVSPGGTVLTCGSSTGAVTSGYYPNWVQQKPGQAPRGLIGGTKFLAPG<br>TPARFSGSLLGGKAALTLSGVQPEDEAEYYCALWYSNRWVFGGGTKLTVL |
| 276. | CD33 AH11 HL x H2C HL | artificial | nt | CAGGTGCAGCTGGTGCAGTCTGGAGCTGAGGTGAAGAAGCCTGGAGAGTCCAGTCAAGGTTCCTG<br>CAAGCAGTGCGGGTATACCTTCACAAACTATGGAATGAACTGGGTGAAGCAGGCTCCAGGACAGG<br>GTTTAAAGTGGATGGCTGATAAAACCACCTCACTGGAGAGCCAACATATGCTGATGACTTCAAG<br>GGACGGGTTACCATGACTAGCGATACATCTCACCAGCACTGCCTATATGGAAATCAGCAGCCTCAG<br>AAGTGATGACACGGCTGTATATTACTGTGCGCGTCGTGGAGTTGATGGTTACTACGTTTACT<br>TTGACTACTGGGGCCAAGGCACTACGGTCACCGTCTCCAGGTGGTGGTGGTTCTGGCGGCGGC<br>GGCTCCGGTGGTGGTTCTGACATCGTGATGACACAGTCTCCAGACTCTCTGTCTCT<br>GGGCGAGAGGACCACCATCAACTGCAAGTCCAGCCAGAGTGTTTTAGACAGCTCCAAGAATAAGA<br>ACTCCTTAGCTTGGTACCAGCAGAAACCAGGACAGCCTCCTAAATTACTCCTTTCTGGGCATCT<br>ACGCGGGAATCCGGGATCCTGACCGATTCAGTGGCAGCGGGTCTGGGACAGATTTCACTCTCAC |

| SEQ ID NO. | DESIGNATION | SOURCE | TYPE | SEQUENCE |
|---|---|---|---|---|
| | | | | TATTGACAGCTGCAGCCTGAAGATTCTGCAACTTACTATTGTCAACAGTCTGCCCACTTCCGA |
| | | | | TCACCTTTGGCCAAGGAACACGACTGGAAGTTGAAATTCTGGAGATTAAATCCGAGGTGGCTCCAGGTGCAGCTG |
| | | | | GTCGAGTCTGGAGGAGGATTGGTGCAGCCTGGAGGGTCCGCCAGGTCCATTGAACTGGAACTCATGTGCAGCCTCTGG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAAATATAATTATGCGACATATTATTCCGATTCAGTGAAGAGACAGG |
| | | | | TTCACCATCTCCAGAGATGATTCAAAAACACTGCTATTCGGTAATAGCTACTACTATATCCTGG |
| | | | | GGAACACTGCCGTGTACTACTGTGTGAGACATGGAACTTCGGTGGTGGTGGTTCTGGCGGCGGC |
| | | | | CTTACTGGGCCAAGGAGACTCTGTTGTCAGACTGTTGACTCAGGAACCTCAGGAACCTCAGCCGTATCACCTGTGG |
| | | | | TCCGGTGGTGGTGGTTCTCAGACTGTTGTGACTCAGGAACCTCAGCCGTATCACCTGTGG |
| | | | | AACAGTCACTCACTTGTGCTCAGGACCTCCAGGTCTCAATAAGGTGGACAAGGCTGTACATCGGCTACTACCAAACTGG |
| | | | | TCCAACAAAAACCAGGCTCAGGACCTCCAGGTTCTCAGAGGCAAGGCTGCCCTCACCCTCAGGGGTACA |
| | | | | ACTCCTGCCAGATTCTCAGGCTCCGCTTGGAGGCAAGGACTAAGTTCCTGCGCCCCCCGGT |
| | | | | GCCAGAGGATGAGGCAGAATATTACTGTCTTATGTACAGCAACCGCTGGGTGTTCGGTGGAG |
| | | | | GAACCAAACTGACTGTCCTA |
| 277. | CD33 AH11 HL x<br>F12Q HL | artificial | aa | QVQLVQSGAEVKKPGESVKVSCKASGYTFTNYGMNWVKQAPGQGLKWMGWINYYTGEPTYADDFK<br>GRVTMTSDTSTSTAYMEISSLRSDDTAVYYCARWSWSDGYYVIFPDYWGQGTTVTVSSggggsggg<br>gsggggsDIVMTQSPDSLTVSLGERTTINCKSSQSVLLDSSKNKNSLAWYQQKPGQPPKLLLSWAS<br>TRESGIPDRPSGSGSGTDFTLTIDSLQPEDSATTYCQQSAHFPITFGQGTRLEIKSGGGSEVQL<br>VESGGGLVQPGGSLKLSCAASGETFNSYAMNWVRQAPGKGLEWVARIRSKYNNYATYADSVKGR<br>FTISRDDSKNTAYLQMNNLKTEDTAVYYCVRHGNFGNSYVSWAYWGQGTLVTVSSGGGGSGGGG<br>SGGGGSQTVVTQEPSLTVSPGGTVLTCGSSTGAVTSGNYPNWVQQKPGQAPRGLIGGTKFLAPG<br>TPARPSGSLLGGKAALTLSGVQPEDEAEYYCVLWYSNRWVFGGGTKLTVL |
| 278. | CD33 AH11 HL x<br>F12Q HL | artificial | nt | CAGGTGCAGCTGGTGCAGTCTGGAGCTGGAGGTGAAGAAGCCTGGAGAGTCAGTCAAGGTCTCCTG<br>CAAGGCTAGCGGGTATACCTTCACAAACTATGGAATGAACTGGGTGAAGCAGGCTCCAGGACAGG<br>GTTTAAAGTGGATGGCTGGATATTCGAGGTATATATTATACTGGAGAGCCAACATATGCTGATGACTTCAAG<br>GGACGGGTTACCATGACTTCGGATACCTCTACCAGCACTGCTATATGGAAATCAGCAGCCTCAG<br>AAGTGATGACACGGCTGTATATTACTGTGCGCGTCATGGAGTGATGGTCTCGGCGGCCGC<br>TTGACTACTGGGCCAAGGCACTGGTCACCGTCTCCTCAGGTGGTGGTGGTGGTCAGCGGTCTCT<br>GGCTCAGGTGGTGGTGGATCAACTGCAAGTCGTGATGACAGTCCAGATCTCCTGACAGTGCTCT<br>GGGCGAGAGGACCACCATCAAGTCAGCCAGAAGCTCCAGGAGTCAGCTCCAGAGAATAAGA<br>ACTCCTTAGCTTGGTACCAGCAGAAACCAGGACAGCCTCCTAAATTACTCCTTTCCTGGGCATCT<br>ACGGATCCCAGCCGGATCCCCTCTGCACCGATTCGTGCCCTCTCCAAATTACTCACTCCTGGACAGAT<br>TATTGACAGCTGCAGCCTGAAGATTCTGCAACTTACTATTGCAACAGTCGCCACACTCCCGA<br>TCACCTTTGGCCAAGGAACACGACTGGAAGTTGAAATTCTGGAGGTGGCTCCAGGTGCAGCTG<br>GTCGAGTCTGGAGGAGGATTGGTGCAGCCTGGAGGGTCCGCCAGGTCCATTGAACTGGAACTCATGTGCAGCCTCTGG<br>ATTCACCTTCAATAAGTACGCCATGAACTGGGTCCGCCAGGCTCCAGGAAAGGGTTTGGAATGG<br>TTGCTCGCATAAGAAGTAAATATAATTATGCCGACATATTATTCCGATTCAGTGAAGAGACAGG<br>TTCACCATCTCCAGAGATGATTCAAAAACACTGCTATTCGGTAATAGCTACTACTATATCCTGG<br>GGAACACTGCCGTGTACTACTGTGTGAGACATGGAACTTCGGTGGTGGTGGTTCTGGCGGCGGC<br>CTTACTGGGCCAAGGAGACTCTGTTGTCAGACTGTTGACTCAGGAACCTCAGGAACCTCAGCCGTATCACCTGTGG<br>TCCGGTGGTGGTGGTTCTCAGACTGTTGTGACTCAGGAACCTCAGCCGTATCACCTGTGG<br>AACAGTCACTCACTTGTGCTCAGGACCTCCAGGTTCTCAATAAGGTGGACAAGGCTGCCATCGGCTACTACCAAACTGG<br>TCCAACAAAAACCAGGCTCAGGACCTCCAGGTTCTCAGAGGCAAGGCTGCCCTCACCCTCAGGGGTACA<br>ACTCCTGCCAGATTCTCAGGCTCCGCTTGGAGGCAAGGACTAAGTTCCTGCGCCCCCCGGT<br>GCCAGAGGATGAGGCAGAATATTACTGTGTTATGTACAGCAACCGCTGGGTGTTCGGTGGAG<br>GAACCAAACTGACTGTCCTA |
| 279. | CD33 AH11 HL x I2C<br>HL | artificial | aa | QVQLVQSGAEVKKPGESVKVSCKASGYTFTNYGMNWVKQAPGQGLKWMGWINYYTGEPTYADDFK<br>GRVTMTSDTSTSTAYMEISSLRSDDTAVYYCARWSWSDGYYVIFPDYWGQGTTVTVSSggggsggg |

| SEQ ID NO. | DESIGNATION | SOURCE | TYPE | SEQUENCE |
|---|---|---|---|---|
| | | | | gsgggsDIVMTQSPDSLTVSLGERTTINCKSSQSVLDSSKNKNSLAWYQQKPGQPPKLLLSWAS TRESGIPDRPSGSGSGTDFTLTIDSLQPEDSATYYCQQSAHFPITFGQGTRLEIKSGGGSEVQL VESGGGLVQPGGSLKLSCAASGFTNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGNYPNWVQQKPGQAPRGLIGGTKFLAPG TPARFSGSLLGGKAALTLSGVQPEDEAEYYCVLWYSNRWVFGGGTKLTVL |
| 280. | CD33 AH11 HL x I2C HL | artificial | nt | CAGGTGCAGCTGGTGCAGTCTGGAGCTGAGGTGAAGAAGCCTGGAGAGTCAGTCAAGGTCTCCTG CAAGGTCTCCGGATACACCTTCACAAACTATGGAATGAACTGGGTGAAGCAGGCTCCAGGACAGG GTTTAAAGTGGATGGGCTGGATAAACACCTACACTGGAGAGCCAACATATGCTGATGACTTCAAG GGACGGGTTACCATGACCAGGGATACCTCCACCAGCACTGCCTATATGGAGCTGAGCAGCCTGAG AAGTGATGACACGGCTGTATATTACTGTGCGCGTGAGTTGATGTTACTACGTTTACT TGACTACTGGGGCCAAGGCACTACGGTCACCGTCTCCTCAGGTGGTGCTCTGGTTCTGGCGGCGC GGCTCCGGTGGTGGTGGTTCTGACACTGACTCCTGACTGTCTCT GGGCGAGGAGGACCACCATCAAGTCAAGTCCAGCCAGAGTGTTTTAGACAGTCCAAGAATAAGA ACTCCTTAGCTTGGTACCAGCAGAAACCAGGACAGCCTCCTGAATTCAGTCAGGATTCCTGCCCA CGCGGGAATCCCAGATCCCTGACAGATTCTCAGTGGCAGTGGATCTGGGACAGATTTCACTCTCAC TATTGACAGCTGCGCCTGCAACTCTATTGTCAACTATTGTTCTGCCACTTCCGA TCACCTTTGGCCAAGGACACGACTGGAGATTAAATCCGGAGGTGTGGCTCAGAGTGCAGCTG GTCGAGTCTGGAGGAGGATTGGTGCAGCCTGGAGGGTCCGCAGGTCATTGAAACTCTCATGTGCAGCCTCTGG ATTCACCTTCAATAAGTACGCCATGAACTGGGTCCGCCAGGCTCCAGGAAAGGGTTTGAATGG TTGCTCGCATAAGAAGTAATATATATATTATGCCAACATATATGCCGATTCAGTGAAGACAGG TTCACCATCTCCAGAGATGATTCAAAAAACACTGCCTATCTCCAGATGAACAGCCTGAAAACTGA GGACACTGCCGTGTACTACTGTGTGAGACATGGAACTTCGGTATAGCTACTACATATCTACTGGG CTTACTGGGGCCAAGGGACCACAGGTCACCGTCTCCTCAGGTGGTGGTGGTTCTGGCGGCGGCGGC TCCGGTGGTGGTGGATCTGTTCTCAGATCTGTGCTGACTCAGGAACCTTCACTCACCGTATCACCTGTGG AACAGTCACACTCACTTGTGGCTCAGGACTCAGTCCTGACATCGGAACATCGGCCAAACTGGG TCCAACAAAACCAGGTCAGGCCCCAAAACTCCTTAATCGTCTATGATGTGACAAGTTCTCTGCCCCGGT ACTCCTTCTCCGGCTCCAAGTCTGGCAACTCGGCCTCCAAGCTGGCGGACTAAGTTCTCACCCTCACCGCTGGGTGTTCGGTGAG GCCAGGATGAGGCAGCAGATATTACTGTGTTCTATGGTACAGCAGCGCTGGGTGTTCGGTGGAG GAACCAAACTGACTGTCCTA |
| 281. | CD33 B3 HL x H2C HL | artificial | aa | QVQLVQSGAEVKKPGESVKVSCKASGYTFTNYGMNWVKQAPGQGLEWMGWINTYTGETNYADKFQ GRVTFTSDITSTAYMELRNLKSDDTAVYYCARMSWSDGYYVYFDYWGQGTTVTVSSggggsggg ggggsgDIVMTQSPDSMTVSLGERTTINCKSSQSVLDSSMKNSLAWYQQKPGQPPKLLLSWAS TRESGIPDRPSGSGSGTDFTLTIDSLQPEDSATYYCQQSAHFPITFGQGTRLDIKSGGGSEVQL VESGGGLVQPGGSLKLSCAASGFTNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGYYPNWVQQKPGQAPRGLIGGTKFLAPG TPARFSGSLLGGKAALTLSGVQPEDEAEYYCALWYSNRWVFGGGTKLTVL |
| 282. | CD33 B3 HL x H2C HL | artificial | nt | CAGGTGCAGCTGGTGCAGTCTGGAGCTGAGGTGAAGAAGCCTGGAGAGTCAGTCAAGGTCTCCTG CAAGGTCTCCGGATACACCTTCACAAACTATGGAATGAACTGGGTGAAGCAGGCTCCAGGACAGG GTTTAGAGTGGATGGGCTGGATAAACACCTACACTGGAGAGACAAACTATGCTGATAAGTTCCAG GGACGCGTTACCTTCACTTCGGATATTACCTCCACAGCACTGCCTATATGGAGCTGAGGAACCTCAA AAGTGATGACACGGCTGTATATTACTGTGCGCGTATGAGTTGGAGTGATGGTTACTACGTTTACT TTGACTACTGGGGCCAAGGCACTACGGTCACCGTCTCCTCAGGTGGTGGTGGTTCTGGCGGCGGC GGCTCCGGTGGTGGTGGATCTGACATCGTGATGACACAGTCTCCAGACTCTCTGACTGTGTCTCT AGGCGAGAGGACCACCATCAACTGCAAGTCCAGCCAGAGTGTTTTAGACAGCTCCAAGAATAAGA ACTCCTTAGCTTGGTACCAGCAGAAACCAGGACAGCCTCCTAAATTACTCATTTCCTGGGCATCT ACGCGGGAATCCGGGATCCCTGACCGATTCAGTGGCAGCGGGTCTGGGACAGATTTCACTCTCAC |

| SEQ ID NO. | DESIGNATION | SOURCE | TYPE | SEQUENCE |
|---|---|---|---|---|
| | | | | TATTGACAGCTGCAGCCTGCAGCCTGAAGATTCTGCAACTTACTATTGTCAACAGTCTGCCCACTTCCCGA |
| | | | | TCACCTTTGCCCAAGGAGCACGACTGGACATTGAAATCCGAGGTGGTGGCTCAGGTGCAGCTG |
| | | | | GTCGAGTCTGGAGGAGGATTGGTGCAGCCTGGAGGGTCCGCCAGGCTCATTGAAACTCTCAGCCTCTG |
| | | | | ATTCACCTTCAATAAGTACGCCATGAACTGGGTTCGCCAGGCTCCAGGAAAGGGTTTGGAATGG |
| | | | | TTGCTCGCATAAGAAGTAATATAATAATTATGCGAACATATTATGCGATTCAGTGAAGACAGG |
| | | | | TTCACCATCTCCAGAGATGATTCAAAAAACACTGCCTATCTACACAGTGAACAGTGAAACTGA |
| | | | | GGAACTGCCGTGTACTACTGTGTGAGACATGGAACTTCGGTAATGACTACTATATCCTACTGGG |
| | | | | CTTACTGGGCCAAGGGACTCTGGTCACCGTCTCCAGTGGTGGTGGTGGTTCTGGCGGCGGC |
| | | | | TCCGGTGGTGGTGGATCTGTTCTCAGACTGTGACTCAGGAACCTCTCACCTGCTATACCGTGTG |
| | | | | AACAGTCACACTTCACTTGTGCTCCAGCACCCGTGTCCAAGGACAACCGCTGGGTGTTCGGTGGAG |
| | | | | TCCAACAAAAACAGGTCAGGCACTCCAGGAATTCCTGCAGCTTGAAGGCAAGGCTGCCCTCACCCTCTCCGCCCCGTA |
| | | | | ACTCCGCCAGATTCTCAGGCTCCCGCTTGACAGCACCATGTGCCCATATCCGACTAAGTTCCTCCGCCCCCGT |
| | | | | GCCAGGAGATGAGGCAGAGAATATTATTACTGTCTGTTCTATGGTACAGCAGCCGCTGGGTGTTCGGTGAG |
| | | | | GAACCAAACTGACTGTCCTA |
| 283. | CD33 B3 HL x F12Q HL | artificial | aa | QVQLVQSGAEVKKPGESVKVSCKASGYTFTNYGMNWVKQAPGQGLEWMGWINTYTGETNYADKFQ |
| | | | | GRVTFTSDTSTSTAYMELRNLKSDDTAVYYCARWSWSDGYYVIPFDYWGQGTTVTVSSggggsggg |
| | | | | gsggggsDIVMTQSPDSMTVSLGERTTINCKSSQSVLLDSSTNKNSLAWYQQKPGQPPKLLLSWAS |
| | | | | TRESGIPDRPSGSGSGTDFTLTIDSLQPEDSATYYCQQSAHFPITFGQGTRLDIKSGGGGSEVQL |
| | | | | VESGGGLVQPGGSLKLSCAASGFTFNSYAMNWVRQAPGKGLEWVARIRSKYNNYATYADSVKGR |
| | | | | FTISRDDSKNTAYLQMNNLKTEDTAVYYCVRHGNFGNSVVSWWAYWGQGTLVTVSSGGGGSGGGG |
| | | | | SGGGGSQTVVTQEPSLTVSPGGTVTLTCGSSTGAVTSGNYPNWVQQKPGQAPRGLIGGTKFLAPG |
| | | | | TPARPSGSLLGGKAALTLSGVQPEDEAEFYCVLWYSNRWVFGGGTKLTVL |
| 284. | CD33 B3 HL x F12Q HL | artificial | nt | CAGGTGCAGCTGGTGCAGTCTGGAGCTGAGGTGAAGAAGCCTGGAGAGTCAGTCAAGGTCTCCTG |
| | | | | CAAGGCTAGCGGATACACCTTCACAAACTATGGAATGAACTGGGTGAAGCAGGCTCCAGGACAGG |
| | | | | GTTTAGAGTGGATGGCTGGATGGATAAACACCTACACTGGAGAGACAAACTATGCTGATAAGTTCCAG |
| | | | | GGACGCGTTACCTTCACTTCTGACACATCCACCAGCACTGCCTATATGGAACTCCGCAACCTCAA |
| | | | | AAGTGATGACACCGCTGTATATTACTGTGCGCGCCTGGAGTTGAGTGATGATTACTGGGCAGAGGTTTACT |
| | | | | TTGACTACTGGGGCCAAGGCACCACTGTCACCGTCTCCTCAGGTGGTGGTGGTTCTGGCGGCGGC |
| | | | | GGCTCCGGTGGTGGTGGATCTGATATCGTGATGACCCAGAGTCCCAGACTGTTGTCACTGTGTCT |
| | | | | GGGCGAGAGGACCACCATCAACTGCAAGTCCAGCCAGAGTGTTTTAGACAGCTCCACGAATAAGA |
| | | | | ACTCCTTAGCTTGGTACCAGCAGAAACCAGGACAGCCTCCCTAAATAACTCCTTTCTGGGCATCT |
| | | | | ACGGGGAATCCGGGATCCCTGACCGATTCAGTGGCAGCGGGTCTGGGACAGATTTCACTCTCAC |
| | | | | TATTGACAGCCTGCAGCCTGAAGATTCTGCAACTTACTATTGTCAACAGTCTGCCCACTTCCCGA |
| | | | | TCACCTTTGGCCAAGGGACCAGGCTGGAGATCAAGCCTGGAGAGGTCCGCCAGGCTCATTGAAACTCTCAGCCTCTG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAATATAATAATTATGCGAACATATTATGCGATTCAGTGAAGACAGG |
| | | | | TTCACCATCTCCAGAGATGATTCAAAAAACACTGCCTATCTACACAGTGAACAGTGAAACTGA |
| | | | | GGAACTGCCGTGTACTACTGTGTGAGACATGGAACTTCGGTAATGACTACTATATCCTACTGGG |
| | | | | CTTACTGGGCCAAGGGACTCTGGTCACCGTCTCCAGTGGTGGTGGTGGTTCTGGCGGCGGC |
| | | | | TCCGGTGGTGGTGGATCTGTTCTCAGACTGTGACTCAGGAACCTCTCACCTGCTATACCGTGTG |
| | | | | AACAGTCACACTTCACTTGTGCTCCAGCACCCGTGTCCAAGGACAACCGCTGGGTGTTCGGTGGAG |
| | | | | TCCAACAAAAACAGGTCAGGCACTCCAGGAATTCCTGCAGCTTGAAGGCAAGGCTGCCCTCACCCTCTCCGCCCCGTA |
| | | | | ACTCCGCCAGATTCTCAGGCTCCCGCTTGACAGCACCATGTGCCCATATCCGACTAAGTTCCTCCGCCCCCGT |
| | | | | GCCAGGAGATGAGGCAGAGAATATTATTACTGTCTGTTCTATGGTACAGCAGCCGCTGGGTGTTCGGTGAG |
| | | | | GAACCAAACTGACTGTCCTA |
| 285. | CD33 B3 HL x I2C HL | artificial | aa | QVQLVQSGAEVKKPGESVKVSCKASGYTFTNYGMNWVKQAPGQGLEWMGWINTYTGETNYADKFQ |
| | | | | GRVTFTSDTSTSTAYMELRNLKSDDTAVYYCARWSWSDGYYVIPFDYWGQGTTVTVSSggggsggg |

| SEQ ID NO. | DESIGNATION | SOURCE | TYPE | SEQUENCE |
|---|---|---|---|---|
| | | | | gsggggsDIVMTQSPDSMTVSLGERTTINCKSSQSVLDSSTNKNSLAWYQQKPGQPPKLLLSWAS |
| | | | | TRESGIPDRFSGSGSGTDFTLTIDSLQPEDSATYYCQQSAHFPITFGQGTRLDIKSGGGGSEVQL |
| | | | | VESGGGLVQPGGSLKLSCAASGETFNKYAMNWVRQAPGKGLEWVARIRSKYNNYATYADSVKDR |
| | | | | FTISRDDSKNTAYLQMNNLKTEDTAVYYCVRHGNFGNSYISYWAYWGQGTLVTVSSGGGGSGGGG |
| | | | | SGGGGSQTVVTQEPSLTVSPGGTVTLTCGSSTGAVTSGNYPNWVQQKPGQAPRGLIGGTKFLAPG |
| | | | | TPARFSGSLLGGKAALTLSGVQPEDEAEYYCVLWYSNRWVFGGGTKLTVL |
| 286. | CD33 B3 HL x I2C HL | artificial | nt | CAGGTGCAGCTGGTGCAGTCTGGAGCTGAGGTGAAGAAGCCTGGAGAGTCAGTCAAGGTCTCCTG |
| | | | | CAAGGCTAGCGGGTATACCTTCACAAACTATGGAATGAACTGGGTGAAGCAGGCTCCAGGACAGG |
| | | | | GTTTAGAGTGGATGGGCTGGATAAACACCTACACTGGAGAGACAAACTTTGCTGATAAGTTCCAA |
| | | | | GGACGCGTTACCTTCACTTCAGACACATCCTCCAGCACTGCCTATATGGAACTGCGTTCTACT |
| | | | | AAGTGATGACACGGCTGTATATTACTGTGCCGCGTGGAGTTGATGGTGTGATTACGACGTTTACT |
| | | | | TGACTACTGGGGCCAAGGCACTACTGGTCACCGTCTCCTCAGGTGGTGGTGGTTCTGGCGGCGGC |
| | | | | GGCTCCGGTGGTGGTGGATCTGATGACAGTGTGACCAGTCCAGCCACCAGTGTTTTAGACAGTCT |
| | | | | GGGCGAGAGGACCACCATCAACTGCAAGTCCAGCCAGAGTGTTTTAGACAGCTCCACGAATAAGA |
| | | | | ACTCCTTAGCTTGGTACCAGCAGAAACCAGGACAGCCTCCTAAATTACTCATTTCTTGGGCATCT |
| | | | | ACGCGGGAATCCGGATCCCTGCCAGGTTCAGTGCAGCGGGTCTGGGACAGATTTCACTCTCAC |
| | | | | TATTGACAGCCTGCAGCCTGAAGATTCTGCAACTTACTATTGTCAACAGTCTGCCCACTTCCCGA |
| | | | | TCACCTTTGGCCAAGGGACACAGACTGGAGATTAAATCCGGAGGTGGTGGCTCAGGTGCAGCTG |
| | | | | GTCAGCTCTGAGAAGAAGCCTGGAGAAGTAAGCAAGTTGTCTCCGGCCAGGGTCATTGAACTGGTGCAGCCTCTGG |
| | | | | ATTCACCTTCAATAAGTACGCCATGAACTGGGTCCGCCAGGCTCCAGGAAAGGGTTTGAATGGG |
| | | | | TTGCTCGCATAAGAGAAGTAAATATAATATATGCGATTCAGTCAGTGAAGACAGG |
| | | | | TTCACCATCTCCAGAGATGACTCCTGTGAGACATGGAACTTCGGTAATAGCTACTACTATCTACTGG |
| | | | | GGACTACTGGGCCAAGGGACCCTGGTCACCGTCTCCTCAGGTGGTGGTGGTTCGGCGGCGGC |
| | | | | TCCGGTGGTGGTGGATCTCAGGTTGTGACTCAGGAACCCTCACTCCACCGTATCACCTGTGG |
| | | | | AACAGTCACACTCACTTGTGCTCCAGGCATGGGACTAAGTTCCTCACCCGTCGGGGTTCCGTGGAG |
| | | | | TCCAACAAAACCAGGCCAGGAATCCGATTTCAGGCTGTGTATGGAGGCCAAGCTGCCCCTCACCC |
| | | | | GCCAGAGGATGAGGCAGCAGATATTACTGTTCTATGGTACAGCACCGCTGGGTTTCGGTGGAG |
| | | | | GAACCAAACTGACTGTCCTA |
| 287. | CD33 F2 HL x H2C HL | artificial | aa | QVQLVQSGAEVKKPGESVKVSCKASGYTFTNYGMNWVKQAPGQGLEWMGWINTYTGETNYADKFQ |
| | | | | GRVTFTSDITSTAYMELRNLKSDDTAVYYCARMSWSDGYYVYPDYWGQGTTVTVSSgggsgggg |
| | | | | gsggggsDIVMTQSPDSLSVSLGERTTINCKSSQSVLDSSTNKNSLAWYQQKPGQPPKLLLSWAS |
| | | | | TRESGIPDRFSGSGSGTDFTLTIDSLQPEDSATYYCQQSAHFPITFGQGTRLEIKSGGGGSEVQL |
| | | | | VESGGGLVQPGGSLKLSCAASGETFNKYAMNWVRQAPGKGLEWVARIRSKYNNYATYADSVKDR |
| | | | | FTISRDDSKNTAYLQMNNLKTEDTAVYYCVRHGNFGNSYISYWAYWGQGTLVTVSSGGGGSGGGG |
| | | | | SGGGGSQTVVTQEPSLTVSPGGTVTLTCGSSTGAVTSGYYPNWVQQKPGQAPRGLIGGTKFLAPG |
| | | | | TPARFSGSLLGGKAALTLSGVQPEDEAEYYCALWYSNRWVFGGGTKLTVL |
| 288. | CD33 F2 HL x H2C HL | artificial | nt | CAGGTGCAGCTGGTGCAGTCTGGAGCTGAGGTGAAGAAGCCTGGAGAGTCAGTCAAGGTCTCCTG |
| | | | | CAAGGCTAGCGGATATACCTTCACAAACTATGGAATGAACTGGGTGAAGCAGGCTCCAGGACAGG |
| | | | | GTTTAGAGTGGATGGGCTGGATAAACACCTACACTGGAGAGACAAACTATGCTGATAAGTTCCAG |
| | | | | GGACGCGTTACCTTCACTTCAGACATCACCTCCAGCACTGCCTATATGGAACTGCGTAACCTCAA |
| | | | | AAGTGATGACACGGCTGTATATTACTGTGCCGCGTGGAGTTGATGGTGTGATTACGACGTTTACT |
| | | | | TGACTACTGGGGCCAAGGCACTACTGGTCACCGTCTCCTCAGGTGGTGGTGGTTCTGGCGGCGGC |
| | | | | GGCTCCGGTGGTGGTGGATCTGACATCGTGATGACACAGTCTCCAGACTCCCTGTCTGTCTCT |
| | | | | CTGGGCGAGAGGACCACCATCAACTGCAAGTCCAGCCAGAGTGTTTTAGACAGCTCCACGAATAAGA |
| | | | | ACTCCTTAGCTTGGTACCAGCAGAAACCAGGACAGCCTCCTAAATTACTCATTTCTTGGGCATCT |
| | | | | ACGCGGGAATCCGGGGTCCCTGACCGATTCAGTGGCAGCGGGTCTGGGACAGATTTCACTCTCAC |

| SEQ ID NO. | DESIGNATION | SOURCE | TYPE | SEQUENCE |
|---|---|---|---|---|
| | | | | TATTGACAGGCTGCAGCCTGAAGATTCTGCAACTTACTATTGTCAACAGTCTGCCCACTTCCCGA |
| | | | | TCACCTTTGGCCAAGGAACACGACTGGAGACTGGAGATTAAATCCGAGGTGGTGCCTCAGGTCAGCCTCTGG |
| | | | | GTCGAGTCTGGAGGAGGATTGGTGCAGCCTGGCAGGGTCCGCCAGACTGAAACTCTCATGTGCAGCTCTGG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAAATATAATAATTATGCCACATATATGCTGAAAGATAGACAGG |
| | | | | TTCACCATCTCCAGAGATGATTCAAAAAACACTGCCTATCTACACAGTCTGCAAATGAACACTGA |
| | | | | GGACACTGCCGTGTACTACTGTGTGAGACATGGAACTTCGGTAATGACTACTATATCCTACTGGG |
| | | | | CTTACTGGGGCCAAGGGACTCTGGTCACCGTCTCCAGTGGTGGTGGTGGTTCTGGCGGCGGC |
| | | | | TCCGGTGGTGGTGGATCTGTTGTGACAGTGTTACTCAGACCTCCTTCCAGTCCTACTCACCTGTGG |
| | | | | AACAGTCACACTCACTTGTGCTCAGGCACCGTTGTCTAATAGGTGGACAAGGCTAAGTTCCTCGCCCCGT |
| | | | | ACTCCTGCCAGATTCTGCAGGCTCCAGCTCCCCTGCCTGGAGGCAAGGCTGTGTGACTAATCAACCTCGCAACCGGCCTA |
| | | | | GCCAGAGGATGAGGCAGAGAATATTACTGTGCTTATGGTACAGCAGCGCTGGGTGTTCGGTGGAG |
| | | | | GAACCAAACTGACTGTCCTA |
| 289. | CD33 F2 HL x F12Q HL | artificial | aa | QVQLVQSGAEVKKPGESVKVSCKASGYTFTNYGMNWVKQAPGQGLEWMGWINTYTGETNYADKFQ GRVTFTSDTSTSTAYMELRNLKSDDTAVYYCARWSWSDGYYVIPFDYWGQGTTVTVSSggggsggg gsgggsDIVMTQSPDSLSVSLGERTTINCKSSQSVLDSSTNKNSLAWYQQKPGQPPKLLSWAS TRESGIPDRPSGSGSGTDFLTIDSLQPEDSATYYCQQSAHFPITFGQGTRLEIKSGGGGSEVQL VESGGGLVQPGGSLKLSCAASGFTFNSYAMNWVRQAPGKGLEWVARIRSKYNNYATYADSVKGR FTISRDDSKNTAYLQMNNLKTEDTAVYYCVRHGNFGNSVVSWWAYWGQGTLVTVSSGGGGSGGGG SGGGGSQTVVTQEPSLTVSPGGTVTLTCGSSTGAVTSGNYPNWVQQKPGQAPRGLIGGTKFLAPG TPARPSGSLLGGKAALTLSGVQPEDEAEFYCVLWYSNRWVFGGGTKLTVL |
| 290. | CD33 F2 HL x I2C HL | artificial | nt | CAGGTGCAGCTGGTGCAGTCTGGAGCTGAGGTGAAGAAGCCTGGAGAGTCAGTCAAGGTCTCCTG CAAGGCTAGCGGATACACCTTCACAAACTATGGAATGAACTGGGTGAAGCAGGCTCCAGGACAGG GTTTAGAGTGGATGGCTGGATCACTTCACATGGAACACCTACACTGGAGAGACAAACTTCCCA GGACGCGGTTACCTTCACTTCTGACACCTCTGGATCAACTGCTATGGAACTCCGAACCTCAA AAGTGATGACACGGCTGTATATTACTGTGCGCGGTGGAGTTGGAGTGATGGTTACTACGTTTACT TTGACTACTGGGGCCAAGGCACCACTGTCACCGTCTCCTCAGGTGGTGGTTCTGGCGGCGGCGC GGCTCCGGTGGTGGTGGATCAGACATCGTGATGACACAGTCTCCAGACTGTTTAGACATGAGCCAGAGTGT TTAGACAGTCCACGAGAATAAGA ACTCCTTAGCTTGGTACCAGCAGAAACCAGGACAGCCTCCAAAATTACTCCTTTCTGGGCATCT ACGCGGAATCCGGAGTCCCTGACCGATTCAGTGGCAGCGGGTCTGGGACAGATTTCACTCTCAC TATTGACAGCCTGCAGCCTGAAGATTCTGCAACTTATTACTGCCAACAGTCTGCCCACTTCCCGA TCACCTTTGGCCAAGGAACACGACTGGAGATTAAATCCGGAGGTGGCGGATCCGAGGTGCAGCTG GTCGAGTCTGGAGGAGGATTGGTGCAGCCTGGAGGGTCATTGAAACTCTCATGTGCAGCTTCTGG ATTCACCTTCAATAAGTACGCCATGAACTGGGTCCGCCAGGCTCCAGGAAAGGGTTTGGAATGG TTGCTCGCATAAGAAGTAAATATAATAATTATGCCACATATATGCTGAAAGATAGACAGG TTCACCATCTCCAGAGATGATTCAAAAAACACTGCCTATCTACACAGTCTGCAAATGAACACTGA GGACACTGCCGTGTACTACTGTGTGAGACATGGAACTTCGGTAATGACTACTATATCCTACTGGG CTTACTGGGGCCAAGGGACTCTGGTCACCGTCTCCAGTGGTGGTGGTGGTTCTGGCGGCGGC TCCGGTGGTGGTGGATCTGTTGTGACAGTGTTACTCAGACCTCCTTCCAGTCCTACTCACCTGTGG AACAGTCACACTCACTTGTGCTCAGGCACCGTTATAATAGGTGGACAAGGCTAAGTTCCTCGCCCCGT ACTCCTGCCAGATTCTGCAGGCTCCAGCTCCCCTGCCTGGAGGCAAGGCTGTGTGACTAATCAACCTCGCAACCGGCCTA GCCAGAGGATGAGGCAGAGAATATTACTGTGCTTATGGTACAGCAGCGCTGGGTGTTCGGTGGAG GAACCAAACTGACTGTCCTA |
| 291. | CD33 F2 HL x I2C HL | artificial | aa | QVQLVQSGAEVKKPGESVKVSCKASGYTFTNYGMNWVKQAPGQGLEWMGWINTYTGETNYADKFQ GRVTFTSDTSTSTAYMELRNLKSDDTAVYYCARWSWSDGYYVIPFDYWGQGTTVTVSSggggsggg |

| SEQ ID NO. | DESIGNATION | SOURCE | TYPE | SEQUENCE |
|---|---|---|---|---|
| | | | | gsgggsDIVMTQSPDSLSVSLGERTTINCKSSQSVLDSSTNKNSLAWYQQKPGQPPKLLLSWAS TRESGIPDRPSGSGSGTDFTLTIDSLQPEDSATYYCQQSAHFPITFGQGTRLEIKSGGGGSEVQL VESGGGLVQPGGSLKLSCAASGETFNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGNYPNWVQQKPGQAPRGLIGGTKFLAPG TPARFSGSLLGGKAALTLSGVQPEDEAEYYCVLWYSNRWVFGGGTKLTVL |
| 292. | CD33 F2 HL x I2C HL | artificial | nt | CAGGTGCAGCTGGTGCAGTCTGGAGCTGAGGTGAAGAAGCCTGGAGAGTCAGTCAAGGTCCTG CAAGCTCAGCGGGTATACCTTCACAAACTATGGAATGAACTGGGTGAAGCAGGCTCCAGGACAGG GTTTAGAGTGGATGGGCTGGATAAACACCTACACTGGAGAGACAAACTATGCTGATAAGTTCCAA GGACGCGTTACCTTCACTTCGACTAGCACTAGCACTCCTAGCAGCGCCTGGAGTTGATGTTATCTACGTTACT AAGTGATGACACGGCCTGTATATTACTGTGCCGCCAAGGCACTGGAGTTGATGTTATCTACGTTACT TTGACTACTGGGCCAAGGCACTACGGTCACCGTCTCCTCAGGTGGTCTGGCTGCTGGAGAGCAGC GGCTCCGGTGGTGGTGGTTCTGACACGTCTCAGAATCTCCTGTCTGCAGTGTCTCTAAGGAGAC GGGCGAGGAGGACCACCATCAACTGCAAGTCCAGCCAGAGTGTTTTAGACAGTCCACGAATAAGA ACTCCTTAGCTTGGTACCAGCAGAAACCAGGACAGCCTCCTAAATTACTCTTTCTGGGCATCT ACGCGGGAATCCGACATCCTGACCAGTCCAGTGGCCAGCGGGTCTGGGACAGATTTCACTCTCAC TATTGACAGCCTGCAGCCTGAAGATTCTGCAACTACTATTGTCAACAGTCTGCCCACTTCCCGA TCACCCTTTGGCCAAGGGACACGAACTGGAGATTAAATCCGGAGGTGTGGCTCCGAGGTGCAGCTG GTCGAGTCTGGAGGAGGCGATTGGTGCAGCTGGGAACCTGGCTCCCAGGGTCATTGAAACTTCATGTGCAGCCTCTGG ATTCACCTTCAATAAGTACGCCATGAACTGGGTCCGCCAGGCTCCAGGAAAGGGTTTGAATGG GTTGCTCGCATAAGAGAAGTAATATATATAATAATGCCGATTCAGTGAAGACAGG TTCACCATCTCCAGAGATGATTCAAAAAACACTGCCTATCTACAAATGAACAACTGAAAACTGA GGACACTGCCGTGTACTACTGTGTGAGACATGGAACTTCGGTAATAGCTACTACATCTCCTACTGGG CTTACTGGGCCAAGGGACCACTGGTCACCGTCTCCTCAGGAACCCTCACTCACCGTATCACCTGTGG TCCGGTGGTGGTGGTTCTCAGACCGTTGTGACTCAGGAACCTTCACTCACTGTATCACCTGTGG AACAGTCACACTCACTCTGTGCTCCTGGGCCTGGTCTAATAGGTGGACAAGGCTGCCCTCACCCTCAGGGGTACA GCCAGAGGATGAGGCAGAGATATTACTGTGTTCATGGTACAGCAGCCGCTGGGTTCGGTGGAG GAACCAAACTGACTGTCCTA |
| 293. | CD33 B10 HL x H2C | artificial | aa | QVQLVQSGAEVKKPGESVKVSCKASGYTFTNYGMNWVKQAPGQGLEWMGWINTYTGEPTYADKFQ GRVTMTTDITSTAYMEIRNLRSDDTAVYYCARMSWSDGYYVFDYWGQGTTVTVSSggggsggggg ggggsgsDIVMTQSPDSLVSLGERTTINCKSSQSVLDSSNKNSLAWYQQKPGQPPKLLLSWAS TRESGIPDRPSGSGSGTDFTLTIDLQPEDSATYYCCQQSAHFPITFGQGTRLEIKSGGGGSEVQL VESGGGLVQPGGSLKLSCAASGETFNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGYYPNWVQQKPGQAPRGLIGGTKFLAPG TPARFSGSLLGGKAALTLSGVQPEDEAEYYCALWYSNRWVFGGGTKLTVL |
| 294. | CD33 B10 HL x H2C HL | artificial | nt | CAGGTGCAGCTGGTGCAGTCTGGAGCTGAGGTGAAGAAGCCTGGTGAGTCAGTCAAGGTCCTG CAAGCTCAGCGGGTATACCTTCACAAACTATGGAATGAACTGGGTGAAGCAGGCTCCAGGACAGG GTTTAGAGTGGATGGGCTGGATAAACACCTACACTGGAGAGCCAACCTATGCTGATAAGTTCCAG GGACGCGTTACCATGACTACGGATATCACTTCTACAGCGCCTACATGGAGATCCGCAACCTCAG AAGTGATGACACGGCCGTATATTACTGTGCCAGGATGAGTTGGAGTGATGGTTACTACGTTTACT TTGACTACTGGGCCAAGGGCACTACGGTCACCGTCTCCTCAGGTGGTGGTTCTGGCGGCGGC GGCTCCGGTGGTGGTGGTTCTGACATCGTGATGACACAGTCTCCAGACTCCCTGAGTGTCTCT CTGGGCGAGAGGACCACCATCAACTGCAAGTCCAGCCAGAGTGTTTTAGACAGTCCAACAATAAGA ACTCCTTAGCTTGGTACCAGCAGAAACCAGGACAGCCTCCTAAATTACTCTTTCTGGGCATCT ACGCGGGAATCCGGGATCCCTGACCGGTTCAGTGGCAGCGGGTCTGGGACAGATTTCACTCTCAC |

| SEQ ID NO. | DESIGNATION | SOURCE | TYPE | SEQUENCE |
|---|---|---|---|---|
| | | | | TATTGACGGCCTGCAGCCTGAAGATTCTGAACTTACTATTGTCAACAGTCTGCCCACTTCCGA |
| | | | | TCACCTTTGCCAAGGACACGACTGGTGCAGCTGGACTGCAGCGGAGTGTGCTGAAACCTCAGCCTCTG |
| | | | | GTCGAGTCTGGAGGAGGATTGGTGCAGCCTGGAGGGTCCGCCAGGTCATTGAACTCTCATGTGCAGCTTCT |
| | | | | ATTCACCTTCAATAAGTACGCCATGAACTGGATCCGCCAGGCTCCAGGAAAGGGTTTGGAATGG |
| | | | | TTGCTCGCATAAGAAGTAAATATAATAATTATGCGACATATTATGCAGATTCAGTGAAGACAGG |
| | | | | TTCACCATCTCCAGAGATGATTCAAAAAACACTGCTCTATCTGCAGATGAACAGCTGAAACTGA |
| | | | | GGAACACTGCCGTGTACTACTGTGTGAGACATGGAACTTCGGTAGTGGTGGTTCTGGCGGCGGC |
| | | | | CTTACTGGGCCAAGGGACTCTGGTCACCGTCTCCAGTGGTGGTGGTGGTTCTGGCGGCGGCGGC |
| | | | | TCCGGTGGTGGTGGATCTCAGACTGTTGTGACTCAGGAACCTCACTGGCTACTACACCTGGTG |
| | | | | AACAGTCACTCACTTGTGCTCAGGACCTCAGGACCACCCCGTGTCTAATAGGTGGACAAGGCT |
| | | | | TCCAACAAAACCAGGTCAGGAGCCTCAGGATTCCCTGCACCTAAATCCTGAGACTATTACTGA |
| | | | | ACTCCTGCCAGATTCTCAGGCTCCCTGCTTGGAGGCAAGGCTGTTAATAGGTGGACAAGGCT |
| | | | | GCCAGAGGATGAGGCAGAATATTACTGTGTCTTATGGTACAGCAGCCGCTGGGTTCGTGGAG |
| | | | | GAACCAAACTGACTGTCCTA |
| 295. | CD33 B10 HL × F12Q HL | artificial | aa | QVQLVQSGAEVKKPGESVKVSCKASGYTFTNYGMNWVKQAPGQGLEWMGWINTYTGEPTYADKFQ |
| | | | | GRVTMTTDTSTSTAYMEIRNLRSDDTAVYYCARWSWSDGYYVYFDYWGQGTTVTVSSggggsggg |
| | | | | ggggsgDIVMTQSPDSLTVSLGERTTINCKSSQSVLLDSSNNKNSLAWYQQKPGQPPKLLLSWAS |
| | | | | TRESGIPDRPSGSGSGTDFTLTIDLQPEDSATYYCQQSAHFPITFGQGTRLEIKSGGGGSEVQL |
| | | | | VESGGGLVQPGGSLKLSCAASGETFNSYAMNWVRQAPGKGLEWVARIRSKYNNYATYADSVKGR |
| | | | | FTISRDDSKNTAYLQMNNLKTEDTAVYYCVRHGNFGNSVVSWWAYWGQGTLVTVSSGGGGSGGGG |
| | | | | SGGGGSQTVVTQEPSLTVSPGGTVTLTCGSSTGAVTSGNYPNWVQQKPGQAPRGLIGGTKFLAPG |
| | | | | TPARFSGSLLGGKAALTLSGVQPEDEAEYYCVLWYSNRWVFGGGTKLTVL |
| 296. | CD33 B10 HL × F12Q HL | artificial | nt | CAGGTGCAGCTGGTGCAGTCTGGAGCTGAGGTGAAGAAGCCTGGTGAGTCAGTCAAGGTCTCCTG |
| | | | | CAAGGCTAGCGGATACACCTTCACAAACTATGGAATGAACTGGGTGAAGCAGGCTCCAGGACAGG |
| | | | | GTTTAGAGTGGATGGGCTGGATAAACACCTACACTGGAGAGCCAACCTATGCTGATAAGTTCCAG |
| | | | | GGACGCGTTACCATGACTACGGACACCTCCACCAGCACTGCCTATATGGAGATCCGAACCTCAG |
| | | | | AAGTGATGACACGGCTGTATATTACTGTGCGCGCGGAGTGATGGTTACTACGTTTACT |
| | | | | TTGACTACTGGGGCCAAGGCACTACTGGTCACCGTCTCCTCAGGTGGTGGTTCTGGCGGCGGC |
| | | | | GGCTCCGGTGGTGGTGGATCTCAGACTGTGATGACACAGTCTCCAGACTCCCTGACTGTGTCT |
| | | | | GGGGCGAGAGACCACCATCAACTGCAAGTCCAGCCAGAGTGTTTTAGACAGTCCAACAATAAGA |
| | | | | ACTCCTTAGCTTGGTACCAGCAGAAACCAGGACAGCCTCCTAAATTACTCTTTCTGGCATCT |
| | | | | ACCCGGGAATCCGGAGTCCCTGACCGATTCAGTGGCAGCGGGTCTGGGACAGATTTCACTCTCAC |
| | | | | TATCAGCGGCCTGCAGCCTGAAGATTCTGCAGTGATTATTGTCAACAGTCTGCCCACTTCCCGA |
| | | | | TCACCTTTGGCCAAGGGACCAAGGTGGAGATCAAAATCCGGAGGTGGCTCCGAGGTGCAGCTG |
| | | | | GTCGAGTCTGGAGGAGGATTGGTGCAGCCTGGAGGGTCCCTGAAACTCTCATGTGCAGCCTCT |
| | | | | ATTCACCTTCAATAAGTACGCCATGAACTGGATCCGCCAGGCTCCAGGAAAGGGTTTGGAATGG |
| | | | | TTGCTCGCATAAGAAGTAAATATAATAATTATGCGACATATTATGCAGATTCAGTGAAGACAGG |
| | | | | TTCACCATCTCCAGAGATGATTCAAAAAACACTGCTCTATCTGCAGATGAACAGCTGAAACTGA |
| | | | | GGAACACTGCCGTGTACTACTGTGTGAGACATGGAACTTCGGTAGTGGTGGTTCTGGCGGCGGC |
| | | | | CTTACTGGGCCAAGGGACTCTGGTCACCGTCTCCAGTGGTGGTGGTGGTTCTGGCGGCGGCGGC |
| | | | | TCCGGTGGTGGTGGATCTCAGACTGTTGTGACTCAGGAACCTCACTGGCTACTACACCTGGTG |
| | | | | AACAGTCACTCACTTGTGCTCAGGACCTCAGGACCACCCCGTGTCTAATAGGTGGACAAGGCT |
| | | | | TCCAACAAAACCAGGTCAGGAGCCTCAGGATTCCCTGCACCTAAATCCTGAGACTATTACTGA |
| | | | | ACTCCTGCCAGATTCTCAGGCTCCCTGCTTGGAGGCAAGGCTGTTAATAGGTGGACAAGGCT |
| | | | | GCCAGAGGATGAGGCAGAATATTACTGTGTCTTATGGTACAGCAGCCGCTGGGTTCGTGGAG |
| | | | | GAACCAAACTGACTGTCCTA |
| 297. | CD33 B10 HL × I2C HL | artificial | aa | QVQLVQSGAEVKKPGESVKVSCKASGYTFTNYGMNWVKQAPGQGLEWMGWINTYTGEPTYADKFQ |
| | | | | GRVTMTTDTSTSTAYMEIRNLRSDDTAVYYCARWSWSDGYYVYFDYWGQGTTVTVSSggggsggg |

| SEQ ID NO. | DESIGNATION | SOURCE | TYPE | SEQUENCE |
|---|---|---|---|---|
| | | | | gsgggsDIVMTQSPDSLITVSLGERTTINCKSSQSVLDSSNNKNSLAWYQQKPGQPPKLLLSWAS TRESGIPDRPSGSGSGTDFTLTIDGLQPEDSATYYCQQSAHFPITFGQGTRLEIKSGGGGSEVQL VESGGGLVQPGGSLKLSCAASGETFNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGNYPNWVQQKPGQAPRGLIGGTKFLAPG TPARFSGSLLGGKAALTLSGVQPEDEAEYYCVLWYSNRWVFGGGTKLTVL |
| 298. | CD33 B10 HL x I2C HL | artificial | nt | CAGGTGCAGCTGGTGCAGTCTGGAGCTGAGGTGAAGAAGCCTGGTGAGTCAGTCAAGGTCTCCTG CAAGGCTAGCGGGTATACCTTCACAAACTATGGAATGAACTGGGTGAAGCAGGCTCCAGGACAG GTTTAGAGTGGATGGGCTGGATAAACACCTACACTGGAGAGCACTGCCTATGCTGATAAGTTCCA GGACGCGTTACCATGACTACGGATACCTCTACCAGCACTGCGAGTTGGAGTGATGGTTACTACTTTACT TGACTACTGGGGCCAAGGCACTACGGTCACCGTCTCCAGGTGGTGGTGGTTCTGGCGGCGGC GGCTCCGGTGGTGGTGGATCTGATGACACAGTCTCCAGATCTCCTGACTCTGTCTCT GGGCGAGAGGACCACCATCAAGTCCAAGTGGAGACAGCCTCCAGATGTTTTAGACAGCTCCAACAATAAGA ACTCCTTAGCTTGGTACCAGCAGAAACCAGGACAGCCTCCTAAGCTCCTGATCTACTCTTTCTGGGCATCT ACGGGGAATCCGGAGTCCCTGACCGGTTCTGACCCACAGATTTCACTCTCAC TATTGACGCCTGCAGCCTGAAGATTCTGCAACTACTATTGTCAACAGTGCCCACTTCCCGA TCACCTTTGGCCAGGACCACGACTGGAGATTAAATCCGGAGGTGTGCCTCCGAGGTGCAGCTG GTCGAGTCTGGAGGAGGATTGGTGCAGCCTGGAGGGTCCCGCAGGTCATTGAAACTTCATGTGCAGCCTCTG ATTCACCTTCAATAAGTACGCCATGACTGGATCGGGTCCAGGAAAGGGTTTGAATGG TTGCTCGCATAAGAAGTAATATATATAATAATGCCGATTCAGTGAAGACAGG TTCACCATCTCCAGAGATGATTCAAAAACACCTGCCTATCCAGAACCTTCGGATAATACTACATATCTACT GGAACTACGCCGTGTACTACTGTGTGAGACATGGAACTTCGGTAATAGCTATATTCGCGGCGAGC CTTACTGGGGCCAAGGACTCTGGTCACCGTCTCCTCAGGTGGTGGTGGTTCTGGCGGCTATCACCTGTGG TCCGGTGGTGGTGGATCTGATATCCAGATGACCCAGTCTCCATCCTCCCTGTCTGCATCTGTGG AACAGTCACACTCACTTGTCGTTCAGGCGCAAGTCAGGACATTAGCAATTATTGAATATGGTTACAATCGGCAACTGGG TCCAACAAAAACCAGGTCAGGCCAGGCAGTCCTGATCTACTATACATCCACATTGACTGGAGGTCCCTGTCCTCGCCCCCGGT ACTCTCTGGGAGCAGATTCTGCAGGCTCAGGCTGTTTATGGTACAGCACCGCTGGGTTCGGTGAG GCCAGGATGAGGCAGATAATATTACTGTCGTATCAACAGGATACGAATAATACCACACCCTGGGTCCGCGGCTA GAACCAAACTGACTGTCCTA |
| 299. | CD33 E11 HL x H2C HL | artificial | aa | QVQLVQSGAEVKKPGESVKVSCKASGYTFTNYGMNWVKQAPGQGLEWMGWINTYTGEPTYADKFQ GRVTMTDTSTSTAYMEIRNLGDDTAVYYCARMsWSDGYYVYFDYWGQGTSVTVSSggggsgggg ggggsDIVMTQSPDSLITVSLGERTTINCKSSQSVLDSSTNKNSLAWYQQKPGQPPKLLLSWAS TRESGIPDRPSGSGSGTDFTLTIDSPQPEDSATYYCQQSAHFPITFGQGTRLEIKSGGGGSEVQL VESGGGLVQPGGSLKLSCAASGETFNKYAMNWVRQAPGKGLEWVARIRSKYNNYATYYADSVKDR FTISRDDSKNTAYLQMNNLKTEDTAVYYCVRHGNFGNSYISYWAYWGQGTLVTVSSGGGGSGGGG SGGGGSQTVVTQEPSLTVSPGGTVTLTCGSSTGAVTSGYYPNWVQQKPGQAPRGLIGGTKFLAPG TPARFSGSLLGGKAALTLSGVQPEDEAEYYCALWYSNRWVFGGGTKLTVL |
| 300. | CD33 E11 HL x H2C HL | artificial | nt | CAGGTGCAGCTGGTGCAGTCTGGAGCTGAGGTGAAGAAGCCTGGAGAGTCCGTGAAGGTCTCCTG CAAGGCTAGCGGGTATACCTTCACAAACTATGGAATGAACTGGGTGAAGCAGGCTCCAGGACAG GTTTAGAGTGGATGGGCTGGATAAACACCTACACTGGAGAGCCAACTATGCTGATAAGTTCCAG GGACGCGTTACCATGACTACGGATACCTCCACCAGCACTGCCAGCTGGAGTTGGAGTGATGGTTACTACGTTTACT AGTGATGACAGACCGGCTGTATATTACTGTGCGCCGGACTACGGTCAGTTGGAGTGATGGTTACTACGTTTACT TTGACTACTGGGGCCAAGGCACTTCGGTCACCGTCTCCTCAGGTGGTGGTGGTTCTGGCGGCGGC GGCTCCGGTGGTGGTGGATCTGATATCGTGATGACACAGTCTCCATCCGACTCCCTGACTGTCTCT GGGCGAGAGGACCACCATCAACTGCAAGTCCAGCCAGAGTGTTTTAGACAGCTCCACAATAAGA ACTCCTTAGCTTGGTACCAGCAGAAACCAGGACAGCCTCCTAAATTACTCCTTTCTGGGCATCT ACGCGGGAATCCGGAGTCCCTGACCGGTTCAGTGGCAGCGGGTCTGGGACAGATTTCACTCTCAC |

| SEQ ID NO. | DESIGNATION | SOURCE | TYPE | SEQUENCE |
|---|---|---|---|---|
| | | | | TATTGACAGCCCGCAGCCTGAAGATTCTGCAACTTACTATTGTCAACAGTCTGCCACTTCCCGA |
| | | | | TCACCTTTGGCCAAGGCACACAGGTCACTGTCCTAGGTGGTGGCGGTAGCGGCGGCGGAGGGAGC |
| | | | | GTCGAGTCTGGAGGAGGATTGGTGCAGCCTGGAGGGTCCGGCCATTGAAACTCTCAGCTGTGCAGCCTCTG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAAATATAATAATTATGCCAACATATATTATGCGATTCAGTGAAGACAGG |
| | | | | TTCACCATCTCCAGAGATGATTCAAAAAACACTGCCTATCTACACAATGGAACTTGAAAACTGA |
| | | | | GGACACTGCCTGGTGTACTACTGTGTGAGACATGGAACTTCGGTAATGACTACTATATCCATGGG |
| | | | | CTTACTGGGCCAAGGGACTCTGGTCACCGTCTCCTCAGGTGGTGGTGGTTCTGGCGGCGGC |
| | | | | TCCGGTGGTGGTGGATCTGTTGTGCTCAGAGTCTGTGCTGTGACTCAGACTCCACCGTACTCACCTGGTG |
| | | | | AACAGTCACACTCACTTGTGCTCAGGCAGCTGTCAATAGGTGGGACTAAGTTCCTCGCCCCCCGT |
| | | | | TCCAACAAAAACCAGGTCAGGCCACTCCCTGCTCCTGAGAGGCAAGGCTGCCCTCACCCTCTCAGGGGTACA |
| | | | | ACTCCTGCCAGATTCTCAGGCTCCGCTTGTGACTCAGACTCCAGGAACCTCTGCCACAGTGGGACTCCTGCCACAGTGG |
| | | | | GCCAGAGGATGAGGCAGAATTATTACTGTGTCTTATGGTACAGCAGCGCTGGGTTCGGTGGAG |
| | | | | GAACCAAACTGACTGTCCTA |
| 301. | CD33 E11 HL x F12Q HL | artificial | aa | QVQLVQSGAEVKKPGESVKVSCKASGYTFTNYGMNWVKQAPGQGLEWMGWINTYTGEPTYADKFQ |
| | | | | GRVTMTTDTSTSTAYMEIRNLGDDTAVYYCARWSWDGYYVFDYWGQGTSVTVSSggggsggg |
| | | | | ggggggsDIVMTQSPDSLTVLGERTTINCKSSQSVLDSSTNKNSLAWYQQKPGQPPKLLLSWAS |
| | | | | TRESGIPDRPSGSGSGTDFTLTIDSPQPEDSATYYCQQSAHFPITFGQGTRLEIKSGGGSEVQL |
| | | | | VESGGGLVQPGGSLKLSCAASGFTNSYAMNWVRQAPGKGLEWVARIRSKYNNYATYYADSVKGR |
| | | | | FTISRDDSKNTAYLQMNNLKTEDTAVYYCVRHGNFGNSYVSWWAYWGQGTLVTVSSGGGGSGGGG |
| | | | | SGGGGSQTVVTQEPSLTVSPGGTVTLTCGSSTGAVTSGNYPNWVQQKPGQAPRGLIGGTKFLAPG |
| | | | | TPARFSGSLLGGKAALTLSGVPQPEDEAEFYCVLWYSNRWVFGGGTKLTVL |
| 302. | CD33 E11 HL x F12Q HL | artificial | nt | CAGGTGCAGCTGGTGCAGTCTGGAGCTGAGGTGAAGAAGCCTGGAGAGTCAGTGAAGGTCTCCTG |
| | | | | CAAGGCTAGCGGATACACCTTCACAAACTATGGAATGAACTGGGTGCGACAGGCTCCAGGACAGG |
| | | | | GTTTAGAGTGGATGGCTGGATATAAACACCTACACTGGAGAGCCAACTACTATGCTGATAAGTTCCAG |
| | | | | GGACGCGTTACCATGACTACGGACACATCCACCAGCACTGCCTATATGGAAATCCGAACCTCGG |
| | | | | AGGTGATGACACCGCTGTATATTACTGTGCGCGTGGAGTTGATGGTTACTACGTTTACT |
| | | | | TTGACTACTGGGGCCAAGGACCACCGTCACCGTCTCCTCAGGTGGCGGTGGCGGCGGGTTCTGGCGGCGGC |
| | | | | GGCTCCGGTGGTGGTGGATCTGACATCGTGATGACACAGTCTCCAGACTCCCTGACTGTGTCTCT |
| | | | | GGGCGAGAGGACCACCATCAACTGCAAGTCCAAGCAGAGTGTTTTAGACAGCTCCACGAATAAGA |
| | | | | ACTCCTTAGCTTGGTACCAGCAGAAACCAGGACAGCCTCCTAAATTACTCCTTTCTGGGCATCT |
| | | | | ACGGAGGAATCCGGACCCTGACGGTTCAGTGCAGTGGCAGGTCAGGACAGATTTCACTCTCAC |
| | | | | TATTGACAGCCCGCAGCCTGAAGATTCTGCAACTTACTATTGTCAACAGTCTGCCCACTTCCCGA |
| | | | | TCACCTTTGGCCAAGGCACACAGGTCACTGTCCTAGGTGGTGGCGGTAGCGGCGGCGGAGGGAGC |
| | | | | GTCGAGTCTGGAGGAGGATTGGTGCAGCCTGGAGGGTCCGGCCATTGAAACTCTCAGCTGTGCAGCCTCTG |
| | | | | ATTCACCTTCAATAAGTACGCCATGAACTGGGTCCGCCAGGCTCCAGGAAAGGGTTTGGAATGG |
| | | | | TTGCTCGCATAAGAAGTAAATATAATAATTATGCCAACATATATTATGCGATTCAGTGAAGACAGG |
| | | | | TTCACCATCTCCAGAGATGATTCAAAAAACACTGCCTATCTACACAATGGAACTTGAAAACTGA |
| | | | | GGACACTGCCTGGTGTACTACTGTGTGAGACATGGAACTTCGGTAATGACTACTATATCCATGGG |
| | | | | CTTACTGGGCCAAGGGACTCTGGTCACCGTCTCCTCAGGTGGTGGTGGTTCTGGCGGCGGC |
| | | | | TCCGGTGGTGGTGGATCTGTTGTGCTCAGAGTCTGTGCTGTGACTCAGACTCCACCGTACTCACCTGGTG |
| | | | | AACAGTCACACTCACTTGTGCTCAGGCAGCTGTCAATAGGTGGGACTAAGTTCCTCGCCCCCCGT |
| | | | | TCCAACAAAAACCAGGTCAGGCCACTCCCTGCTCCTGAGAGGCAAGGCTGCCCTCACCCTCTCAGGGGTACA |
| | | | | ACTCCTGCCAGATTCTCAGGCTCCGCTTGTGACTCAGACTCCAGGAACCTCTGCCACAGTGGGACTCCTGCCACAGTGG |
| | | | | GCCAGAGGATGAGGCAGAATTATTACTGTGTCTTATGGTACAGCAGCGCTGGGTTCGGTGGAG |
| | | | | GAACCAAACTGACTGTCCTA |
| 303. | CD33 E11 HL x I2C HL | artificial | aa | QVQLVQSGAEVKKPGESVKVSCKASGYTFTNYGMNWVKQAPGQGLEWMGWINTYTGEPTYADKFQ |
| | | | | GRVTMTTDTSTSTAYMEIRNLGDDTAVYYCARWSWDGYYVFDYWGQGTSVTVSSggggsggg |

| SEQ ID NO. | DESIGNATION | SOURCE | TYPE | SEQUENCE |
|---|---|---|---|---|
| | | | | gsgggsDIVMTQSPDSLTVSLGERTTINCKSSQSVLDSSTNKNSLAWYQQKPGQPPKLLLSWAS |
| | | | | TRESGIPDRFSGSGSGTDFTLTIDSPQPEDSATYYCQQSAHFPITFGQGTRLEIKSGGGSEVQL |
| | | | | VESGGGLVQPGGSLKLSCAASGFTFNKYAMNWVRQAPGKGLEWVARIRSKYNNYATYYADSVKDR |
| | | | | FTISRDDSKNTAYLQMNNLKTEDTAVYYCVRHGNFGNSYISYWAYWGQGTLVTVSSGGGSGGGG |
| | | | | SGGGSQTVVTQEPSLTVSPGGTVTLTCGSSTGAVTSGNYPNWVQQKPGQAPRGLIGGTKFLAPG |
| | | | | TPARFSGSLLGGKAALTLSGVQPEDEAEYYCVLWYSNRWVFGGGKLTVL |
| 304. | CD33 E11 HL x I2C HL | artificial | nt | CAGGTGCAGCTGGTGCAGTCTGGAGCTGAGGTGAAGAAGCCTGGAGAGTCAGTCAAGGTCTCCTG |
| | | | | CAAGGCTAGCGGCTATACCTTCACAAACTATGGAATGAACTGGGTGAAGCAGGCTCCAGGACAGG |
| | | | | GTTTAGAGTGGATGGCTGGATAAACACCTACACTGGAGAGCCAACCTATGCTGATAAGTTCCAG |
| | | | | GGACGCGTTACCATGACTACGGATACCTCTACCAGCACTGCTGCCTATATGGAAATCCGCAACCTCG |
| | | | | AGGTGATGACACGGCTGTATATTACTGTGCGCGTGGAGTTGGAGTTGATGGTTACTACGTTACT |
| | | | | TTGACTACTGGGGCCAAGGCACTTCTGGTCACCGTCTCCTCAGGTGGTGGTGGTTCTGGCGGCGC |
| | | | | GGCTCCGGGTGGTGGTTCTCAGACTGTGACAGTCCAGAGTCCCAGAAGTGTTTAGACAGCTCCAGAATAAGA |
| | | | | GGGCGAGGAGACCACCATCACAACTGCAAGTCCAGCCAGCCTCCTAATTACTCCTTCGCAATCT |
| | | | | ACTCCTTAGCTTGTTACCAGCAGAAACCAGGACAGCCTCGGGATCCTCAGTGGCAGCAGGAATTTCACTCTCAC |
| | | | | ACGCGGGAATCCGGATCCCTGAAGATTCTGCAACTTACTATTGTCAACAGTCTGCCCACTTCCCGA |
| | | | | TATTGACAGCCCGCACCTGAAGACTGGAGATTAAATCCGGAGGTGTGCCTCCGAGGTGCAGCTG |
| | | | | TCACCCTTTGGCCAAGGGACACGACTGGAGGTGCAGCCTGGAGGTCCGCCAGGCTCATTGAAACTGGGTCCGGCAGGCTCAGCCCTCTGG |
| | | | | GTCGAGTCTGAGAGAGTAAGTAGCCATGAACTGGGTCCGCCAGGCTCCAGGAAAGGGTTTGAATGG |
| | | | | ATTCACCTTCAATAAGAAGTAATAATATAATATATGCAACAATATATGCCGATTCAGTGAAAGACAGG |
| | | | | TTGCTCGCATAAGAAGTAATAATATAATATATGCAACAATATATGCCGATTCAGTGAAAGACAGG |
| | | | | TTCACCATCTCCAGAGATGATTCAAAAAACACCTGCTATCCTCCAGAGACTATATCTACTGGG |
| | | | | GGACACTGCCGTGTACTACTGTGTGAGACATGGGAACTTCGGTAATAGCTACATATCTTACTGGG |
| | | | | CTTACTGGGGCCAAGGACTCTGGTCACCGTCTCCTCAGGTGGTGGTGGTTCTGGCGGCGGCGGC |
| | | | | TCCGGTGGTGGTGGTTCTCAGACTGTGTGACAGTCCAGAGTCCCTCACTCTGTCCGTATCACCTGTGG |
| | | | | AACAGTCACACTCACTGTGGCTCCTCCGACTGGTGTTACATCGGCAGTCTTCCTGCCCCGGT |
| | | | | TCCAACAAAAACAGGTCAGGCACCCCGTGGTCTTGAAGGCAGGCTGCCCTCACCCTCAGGGGTACA |
| | | | | ACTCCTGCCCAGATCTCAGCTCCAGCACTGTGTGATTTCATGGTACAGCACCGCTGGGTTCGGTGAG |
| | | | | GCCAGAGGATGAGGCAGATAATTACTGTGTTCTATGGTACAGCACCGCTGGGTTCGGTGAG |
| | | | | GAACCAAACTGACTGTCCTA |
| 305. | CD33 | human | nt | ATGGGATGGAGCTGTATCATCCTCTTCTTGTTGTAGCAGCAACAGCTACAGGTGTACACTCCGATCCAAA |
| | | | | TTTCTGGCCTGCAAGTGCAGGAGTCAGGTGACGGGTACAGGAGGGTTTGTGCGTCCTCCGTGCCCTGCA |
| | | | | CTTTCTTCCATCCATATATCCGGGACTCTCCAGCGGGATCCCACCACAAGAATCCCAGTTCATGGTACTGTTCCGGAA |
| | | | | GGAGCCATTATATCCGGGACTCTCCAGCGGGATCCCCACCACAAGCAAGCTAGATCAAGAAGTACAGGAGGA |
| | | | | GACTCAGGGCAGATTCCGCCCTCTGGGATCCAGTAGGAACAGCTGCTCCTGAGCATCGTAG |
| | | | | ACGCCAGGAGGATAATGGTTCATACTTTCTTCGATGGAGGAGGAAGTACCAAATACAGT |
| | | | | TACAAATTCCCCAGCTCTCTGTGCATGTGACAGACTTGACCCACAGGCCCAAAATCTCATCC |
| | | | | TGGCACTCTTAGAACCCGGCCACTCCAAAAAACCTGACCTGCTCCCTCGGTGTCCTGGGCCCTGTGAGCAGG |
| | | | | GAACACCCCGATCTTCTCCTGGTTGTCAGCTGCCCAGAACCACGGCCCAACCTGACCTGTCAGGTGAA |
| | | | | TCCTCGGTGCTCATAATCACCCCACGGAGAAACCATCCCAGTGCTCACCTATGTTCCACAGA |
| | | | | GTTCGCTGGACGTGTGATACGGGAGAAACCACCAAGAGAGTCAACCTCACCATGTTCCACAGA |
| | | | | ACCCAACAACTGGTATCTTTCCAGGAGATGGCTCAGGAGAACAAGAGACCAGACGAGTGTT |
| | | | | CATGGGGCCATTGAGGAGGTGGTGTTACAGCCCTGCTCCGCTCCATCATCTCTGCCTATCATCTTCTT |
| | | | | CCACAGGGTCAGCCTCCCGAAACACCAGGAGCAGCCAAGAAGTCCAAGTTACATGACACACCCACCCCTCA |
| | | | | AGCTGTTCAGGTGCCGCCCCTACTGTGGAGATGGAGAGCTGCATTATGCTTCCCTCACTT |
| | | | | TCATGGGATGAATCCTTCCAAGGACACCTCCACCCGAATACTCCACCGAGGTCAGGAGCCCCCGGC |
| | | | | ATCATCACCATCATTGA |

| SEQ ID NO. | DESIGNATION | SOURCE | TYPE | SEQUENCE |
|---|---|---|---|---|
| 306. | CD33 | human | aa | MGWSCIILFLVATATGVHSDPNFWLQVQESVTVQEGLCLVPCTFFHPIPYYDKNSPVHGYWFRE GAIISGDSPVATNKLDQEVQEETQGRFRLLGDPSRNNCSLSIVDARRRDNGSYFFRMERGSTKYS YKSPQLSVHVTDLTHRPKILIPGTLEPGHSKNLTCSVSWACEQQTPPIFSWLSAAPTSLGPRTTH SSVLIITPRPQDHGTNLTCQVKFAGAGVTTERTIQLNVTYVPQNPTTGIFPGDSGKQBTRAGVV HGAIGGAGVTALLALCLIFFIVKTHRRKAARTAVGRNDTHPTGSASPKHQKKSKLHGPTETS SCSGAAPTVEMDEELHYASLNFHGMNPSKDTSTEYSEVRTQSGHHHHHH |
| 307. | CD33 | macaque | nt | ATGCGCTGCTGCTACTGTGCCCCTGCTGTGGCAGGGCCCTGGCTATGGATCCAAGAGTCAG GCTGAAGTGCAGGACGTCAGTGACGATGACAGGGGTTTGTGCCTCCTGGAAGACTTTCT TCCATCCGTGCTACCCACCAGAGAATTCCCAGTTCATGTTCATGTTCCGGAAGAGGAGC ATTGTATCCTTGACTCCTCCTTGGGGATCCAGAGAACAACTGCTCCTGCACATCGAGATGCCA GGGCCGATCCCCTCTATACTTCCTGCTGAGATGAAAGAAGTACCAAATACAGTTACAAA TCTACCCAGCTCTCTGTGCATGTCACACGATCACCACGACCAGCACCAAATCTCATCCTGAGC CCTAGCCTCTGACCACTCCAAAAACCTGACTGCCTGTGCCTTGGCTCTGTGAGCAGGAACAC CTCCAATCTTCTCTGGATGTCAGCTGCCCCCACCACCGGACCACCTCACCTGTCAGTGAAGTTCCC GTGCTCATAATCACCCCACGGCCCACTGCTCGAGACTGACTACACAGACCCAA GAACTGATATCTTTCAGATGCTCTGCTGCTGGCAGGATTGGGCAGGAGTGTTCAGGAGCCATCACAG GCTGGTGTCACAGTCCTGCTCGCTCTTGTCTCTGCACTTCCTCACAGTGAAGACTCACAG CGAAAACCAGGAGAAGCCAAGTACATGGCGGGCTGAACCTGACCACCAGGCCCAACATCCT CTTACTGTGGAGATGAGAGACTCCAGAGGTCAGAGACCCAGTGA TGAGGACACCTCCACCGAATACTCCAGAGGTCAGAGACCCAGTGA |
| 308. | CD33 | macaque | aa | MPLLLLLLPLLWAGALAMDPRVRLEVQESVTVQEGLCLVPCTFFHPVPYHTRNSPVHGYWFREGA IVSLLDSPVATNKLDQEVQEETQGRPRLLGDPSRNNCSLSIVDARRRDNGSYFFRMEKGSTKYSYK STQLSVHVTDLTHRPQILIPGALDPDHSKNLTCSVPWACEQQTPPIFSWMSAAPTSLGLRTTHSS VLIITPRPQDHGTNLTCQVKFPGAGVTTERTIQLNVSYASQNPRTDIFLGDGSKQGVVQGAIGG AGVTVLLALCLCLIFFTVKTHRRKAARTAVGRIDTHPATGPTSSKHQKKSKLHGATETSGCSGTT LTVEMDEELHYASLNFHGMNPSEDTSTEYSEVRTQ |
| 309. | 1-27 CD3-Fc + Leader | artificial | nt | ATGGGATGGAGCTGTATCATCCTCTTCTTGGTAGCACAGCTACAGGTGTACACTCCAAGATGG TAATGAAGAAATGGGTGGTATTACAGACACCATATAAAGTCTCCATCTCTGAACCACAGTAA TATTGACATCCGAGAGCCCCAACCTTGTGACAAAACTCACACATGCCCACCGTGCCCAGCACCT GAACTCCTGGGGGGACCGTCAGTCTTCCTCTTCCCCCCAAAACCCAAGGACACCCTCATGATCTC CCGACCCCTGAGGTCACATGCGTGGTGGTGGACGTGAGCCACGAAGACCCTGAGGTCAAGTTCA ACTGGTACGTGGACGGCGTGGAGGTGCATAATGCCAAGACAAAGCCGCGGGAGGAGCAGTACAAC AGCACGTACCGTGTGGTCAGCGTCCTCACCGTCCTGCACCAGGACTGGCTGAATGGCAAGGAGTA CAAGTGCAAGGTCTCCAACAAAGCCCTCCCAGCCCCCATCGAGAAAACCATCTCCAAAGCCAAAG GGCAGCCCCGAGAACCACAGGTTGTACACCCTGCCCCCATCCCGGGATGAGCTGACCAAGAACCAG GTCAGCCTGACCTGCCTGGTCAAAGGCTTCTATCCCAGCGACATCGCCGTGGAGTGGGAGAGCAA TGGGCAGCCGGAGAACAACTACAAGACCACGCCTCCCGTGCTGGACTCCGACGGCTCCTTCTTCC TCTATAGCAAGCTCACCGTGGACAAGAGCAGGTGGCAGCAGGGGAACGTCTTCTCATGCTCCGTG ATGCATGAGGCTCTGCACAACCACTACACGCAGAAGAGCCTCTCCCTGTCCCCGGGTAAATAG |
| 310. | 1-27 CD3-Fc + Leader | artificial | aa | MGWSCIILFLVATATGVHSQDGNEEMGGITQTPYKVSISGTTVILTSGEPKSCDKTHTCPPCPAP ELLGGPSVFLFPPKPKDTLMISRTPEVTCVVVDVSHEDPEVKFNWYVDGVEHNAKTKPREEQYN STYRVVSVLTVLHQDWLNGKEYKCKVSNKALPAPIEKTISKAKGQPREPQVYTLPPSREEMTKNQ VSLTCLVKGFYPSDIAVEWESNGQPENNYKTTPPVLDSDGSFFLYSKLTVDKSRWQQGNVFSCSV MHEALHNHYTQKSLSLSPGK |

| SEQ ID NO. | DESIGNATION | SOURCE | TYPE | SEQUENCE |
|---|---|---|---|---|
| 311. | CD33 UD H2C HL x AF5 HL | artificial | aa | EVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGS GGGGSGGGGSQTVVTQEPSLTVSPGGTVTLTCGSSTGAVTSGYYPNWVQQKPGQAPRGLIGGTKF LAPGTPARFSGSLLGGKAALTLSGVQPEDEAEYYCALMYSNRWVFGGGTKLTVLSGGGGSQVQLV QSGAEVKKPGASVKVSCKASGYTFTNYGMNWVKQAPGQGLKWMGWINTYTGEPTYADDFKGRVTM TSDTSTAYLELHNLRSDDTAVYYCARWSWDGYYVYPDYWGQGTTVTVSSGGGGSGGGGSGGGGS GSDIVMTQSPDSLTVSLGERTTINCKSSQSVLDSSKNKNSLAWYQQKPGQPPKLLLSWASTRESG IPDRFSGSGSGTDFTLTIDSLQPEDSATYYCQQSAHFPITFGQGTRLEIK |
| 312. | CD33 UD H2C HL x AF5 HL | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATAAGTACGCCATGAACTGGGTCCGCCAGGCTCCAGGAAAGG GTTTGGAATGGGTTGCTCGCATAAGAAGTAAATATAATTATTATGCAACATATTATGCCGATTCA GTGAAGACAGGTTCACCATCTCCAGAGATGATAATAATAATAATTATAATGCAACATATTATGCCGATTCA CTTGAAACTGAGGACACTGCCGTGTACTACTGTGTGAGACATGGAACTTCGGTAATAGCTACA TATCCTACTGGGCTTACTGGGGCCAAGGGACTCTGGTCACCGTCTCCTCAGGTGGTGGTGGTTCT GGCGGCGGCGGCTCCGGTGGTGGTGGATCTCAGACTGTTGTGACTCAGGAACCTTCACTCACCGT ATCACCTGGTGGAACAGTCACACTGGTCAGGACCACCCCGGTCTAATAGGTGGACTAAGTTC ACCCAAACTGGGTCCAACAAACCAGGTCAGGACCACCCCGGTCTAATAGGTGGACTAAGTTC CTCGCCCCGGTACTCCTGCCAGATTCTCAGGCTCCAGGTTCTTGAGGCAAGGCTGCCCCTCACCCT CTCAGGGTACAGCCCAGAGGATGAGGAGAATATTACTGTGCTTATGTTACAGCAGTGGCAGTTC TGTTCGGTGGAGGAACCAAACTGACTGTCCTATCCGGAGGTGGTGGCTCAAGGTCCAGCTGGGTA CAGTCTGGAGCTGAGGTGAAGAAGCCTGGGGCAAGCTCCAGGCAGTCTGATGACTTCAAGGGACG AGGTTTAAAGTGAAGCGTACAACACCGGC TACCTTCACAAACTATGAATGGATGAACCCTTATGGGGCAGTCGACATATCCAAGGGTTAAAGTGGATGG CTGGATAAACACCTACACTGGAGAGCCAACATATGCTGATGACTTCAAGGGACGAGTCACCATG ACTTCAGATACCTCCACAGCTTACCTTGGAGTTGGAGTGATGGTTACACCGTTTACTTGACTACGGC TGTATATTACTGTGCGCGACCGTCTCCAGTGGGTGGTTGTCGCGCTGACCCTCCGCTGGTGGCTACGGG AAGGCACTACCTACGGTGCACCATCGTGATGACACAGTCTCAGACTCCCTGACTGTCTCTGGGCCAGGACCAC CATCAACTCCAAGTCCAGCCAGAGTGTTTTAGACACTACTCCTTTCTGGACAGATTTCACTTGCCCACTCAGCCTGCA ATCCCTGACCGATTCTGCCAACTTACATTGTCAACAGTCTGCCAATCTTCTTCCCATCACCTTTGCCAAG GCTGAAGATTCTGCCAACTTACATTGTCAACAGTCTGCCAATCTTCTTCCCGATCACCTTTGCCAAG GGACACGACTGGAGATTAAA |
| 313. | CD33 UD F12Q HL x AF5 HL | artificial | aa | EVQLVESGGGLVQPGGSLKLSCAASGFTFNSYAMNWVRQAPGKGLEWVARIRSKYNNYATYYADS VKGRFTISRDDSKNTAYLQMNNLKTEDTAVYYCVRHGNFGNSYVSWAYWGQGTLVTVSSGGGGS GGGGSGGGGSQTVVTQEPSLTVSPGGTVTLTCGSSTGAVTSGNYPNWVQQKPGQAPRGLIGGTKF LAPGTPARFSGSLLGGKAALTLSGVQPEDEAEYYCVLMYSNRWVFGGGTKLTVLSGGGGSQVQLV QSGAEVKKPGASVKVSCKASGYTFTNYGMNWVKQAPGQGLKWMGWINTYTGEPTYADDFKGRVTM TSDTSTAYLELHNLRSDDTAVYYCARWSWDGYYVYPDYWGQGTTVTVSSGGGGSGGGGSGGGGS GSDIVMTQSPDSLTVSLGERTTINCKSSQSVLDSSKNKNSLAWYQQKPGQPPKLLLSWASTRESG IPDRFSGSGSGTDFTLTIDSLQPEDSATYYCQQSAHFPITFGQGTRLEIK |
| 314. | CD33 UD F12Q HL x AF5 HL | artificial | nt | GAGGTGCAGCTGGTCGAGTCTGGAGGAGGATTGGTGCAGCCTGGAGGGTCATTGAAACTCTCATG TGCAGCCTCTGGATTCACCTTCAATAGTTACGCCATGAACTGGGTCCGCCAGGCTCCAGGAAAGG GTTTGGAATGGGTTGCTCGCATAAGAAGTAAATATAATAATTATGCCGATTCA GTGAAGGGCAGGTTCACCATCTCCAGAGATGATAATAAATACAACTGCCTATCTACAAATGAACAA CTTGAAACTGAGGACACTGGAGCAGTCTATGCTATCCGTGTAGACATGGAACTTCGGTAATAGCTACG TTTCCTGGTGGGCTCCGGTCCGGTTGTGACTCAGGAACCTTCACTCACCGT GGCGGCGGCGGCTCCGGTGGTGGTGGATCTCAGACTGTTGTGACTCAGGAACCTTCACTCACCGT |

| SEQ ID NO. | DESIGNATION | SOURCE | TYPE | SEQUENCE |
|---|---|---|---|---|
| | | | | ATCACCTGGTGGAACAGTCACACTTCACTTGTGGCTTCCTGACTGGGCTGTGTTACATCTGGCAACT<br>ACCCAAACTGGGTCCAACAAAACCAGGTCAGGCACCTCCCTGTTCAGGTCTAATAGGTGGACTAAGTTC<br>CTCGCCCCGGTACAGCCAGGATGAGGCAGAATATTACTGTGTTCTATGGTACAGCAAGCTGCCCTCACCCT<br>TCAGGGGTACAGCCAGAGGATGAGGCAGAATATTACTGTGTTCTATGGTACAGCAAGCTGCCCTCACCCT<br>TGTTCGGTGCAGGAACCAAACTGACTGTCCTATCCGAGGTGGTTCCCAGTGCAGCTGGTC<br>CAGTCTGGAGCTGAGGTGAAGAAGCCTGGGGCCTCAGTCAAGGTCTCCTGCAAGGCTAGCGGGTA<br>TACCTTCACAAACTATGGAATGAATTGGGTGAGACAGGCTCCAGGACAGGGTTTAAAGTGGATGG<br>GCTGGATAAACACCTACACTGGAGAGCCAACATATGCTGATGACTTCAAGGGACGGTTACCATG<br>ACTTCGGATACCTTCAGCCTATTTGGAACTCCACAACCTGTTACTTGACTGCTGGGGCC<br>TGTATATTACTGTGCGCGGTCAGTCTCCCAGTGTGTGATGGTTACTACGTTACTTGACTACTGGGGCC<br>AAGGCACTACGGTCACCGTCTCCAGTGGTGGTGGTTCTGGCGGCGGCGGCTCCGGTGGTGGT<br>GGTTCTGACATCGTGATGACACAGTCTCCAGACTCTCTGCTGTGTCTCTGGGCGAGAGGCCAC<br>CATCAACTGCAAGTCCAGCCAGAGTGTTTTAGACAGCTCCAACAATAAGAACTCCTTAGCTTGT<br>ACCAGCAGAAACCAGGACAGCCTCCTAAATTACTCTTCTGGGACAGTCTGCCCATCTACCGGGAATCCGG<br>ATCCCTGACCGATTCTCAGCTCCAGTCAGTGGCAGCGGGTCTGGGACAGATTTCACTCTCACTATTGACAGCCTGCA<br>GCCTGAAGATTCTGCAACTTACTATTGTCAACAGTCTTACAGTACTCCCATCACCTTTGGCCAAG<br>GGACACGACTGGAGATTAAA |
| 315. | CD33 UD I2C HL x<br>AF5 HL | artificial | aa | EVQLVESGGGLVQPGGSLKLLSCAASGFTFNKYAMNWVRQAPGKGLEWVARIRSKYNNYATYYADS<br>VKDRFTISRDDSKNTAYLQMNNLKTEDTAVYYCVRHGNFGNSYISYWAYWGQGTLVTVSSGGGGS<br>GGGGSGGGGSQTVVTQEPSLTVSPGGTVTLTCGSSTGAVTSGNYPNWVQQKPGQAPRGLIGGTKF<br>LAPGTPARFSGSLLGGKAALTLSGVQPEDEAEYYCVLMYSNRWVFGGGTKLTVLSGGGGSVQLV<br>QSGAEVKKPGASVKVSCKASGYTFTNYGMNWVKQAPGQGLKWMGWINTYTGEPTYADDFKGRVTM<br>TSDTSTSTAYLELHNLRSDDTAVYYCARWSNDGYYVFPDYWGQGTTVTVSSGGGGSGGGGSGGGG<br>GSDIVMTQSPDSLTVSLGERTTINCKSSQSVLDSSKNKNSLAWYQQKPGQPPKLLLSWASTRESG<br>IPDRFSGSGSGTDFTLTIDSLQPEDSATYYCQQSAHPITFGQGTRLEIK |
| 316. | CD33 UD I2C HL x<br>AF5 HL | artificial | nt | GAGGTGCAGCTGGTCGAGTCTGGAGGAGGATTGGTGCAGCCTGGAGGGTCCAGCCTGAAACTCTCATG<br>TGCAGCCTCTGGATTCACCTTCAATAAGTACGCCATGAACTGGGTCCGACAGGCTCCAGGAAAGG<br>GTTTGGAATGGGTTGCTCGCATAAGAAGTAAATATAATATTACGAACATATTATGCCGATTCA<br>GTGAAAGACAGGTTCACCATCTCCAGAGATGATTCAAAAAACACTGCTATCTACAAATGAACAA<br>CTTGAAAACTGGGCTTCACCATCTCCAGAGATGATTCAAAAAACACTGCTATCTACAAATGAACAA<br>CTTGAAAACTGAGGACACTGCCGTGTACTACTGTGTGAGACATGGGAACTTCGGTAATAGCTACA<br>TATCCTACTGGGCTTACTGGGGCCAAGGGACTCTGGTCACCGTCTCCTCAGGTGGTGGTGGTTCT<br>GGCGGCGGCGGCTCCGGTGGTGGTGGTTCTCAGACTGTTGTGACTCAGGAACCTTCACTCACCGT<br>ATCACCTGGTGGTCCAACAAAACCAGGTCAGGCACCTCCCTGTTCAGGTCTAATAGGTGGACTAAGTTC<br>ACCCAAACTGGGTCCAACAAAACCAGGTCAGGCACCTCCCTGTTCAGGTCTAATAGGTGGACTAAGTTC<br>CTCGCCCCCGGTACAGCCAGATGAGGCAGAATATTACTGTGTTCTATGGTACAGCAGCTGCCCTCACCCT<br>TGTTCGGTGGAGCAACTAAGCTGACTGTCCTATCCGAGGTGTTCCCAGTGCAGCTGGTC<br>CAGTCTGGAGCTGAGGTGAAGAAGCCTGGGGCCTCAGTCAAGGTCTCCTGCAAGGCTAGCGGGTA<br>TACCTTCACAAACTATGGAATGAATTGGGTGAAGACAGGCTCCAGGACAGGGTTTAAAGTGGATGG<br>GCTGGATAAACACCTACACTGGAGAGCCAACATATGCTGATGACTTCAAGGGACGGGTTACCATG<br>ACTTCGGATACCTTCACCAGTCTCCACAAACCTGTTACTTCACTGCTGGGGCC<br>TGTATATTACTGTGCGCGGTGGAGTGGAGTGATGGTTACTACGTTACTTTGACTACTGGGGCC<br>AAGGCACTACGGTCACCGTCTCCTCAGGTGGTGGTGGTTCTGGCGGCGGCGGCTCCGGTGGTGGT<br>GGTTCTGACATCGTGATGACACAGTCTCCAGACTCTCTGACTGTGTCTCTGGGCGAGAGGCCAC<br>CATCAACTGCAAGTCCAGCCAGAGTGTTTAGACAGCTCCAACAATAAGAACTCCTTAGCTTGT<br>ACCAGCAGAAACCAGGACAGCCTCCTAAATTACTCTTCTGGGACAGTCTGCCCATCTACCGGGAATCCGG<br>ATCCCTGACCGATTCTCAGCTCCAGTCAGTGGCAGCGGGTCTGGGACAGATTTCACTCTCACTATTGACAGCCTGCA<br>GCCTGAAGATTCTGCAACTTACTATTGTCAACAGTCTGCCCATCTACCTTTGGCCAAG<br>GGACACGACTGGAGATTAAA |

| SEQ ID NO. | DESIGNATION | SOURCE | TYPE | SEQUENCE |
|---|---|---|---|---|
| 317. | MCSP-A9 HL x H2C HL | artificial | aa | QVQLVQSGAEVKKPGASVKVSCKASGYPFTGYYMHWVRQAPGQGLEWMGWINPNSGGTNYAQKFQ GRVTITADESTSTAYMELSRLRSDDTAVYYCAKSWVSWFASWGQGTLVTVSSGGGSGGGGSGGG GSDIVMTQSPDSLAVSLGERATINCKSSQSVLSSSNNKNYLNWYQQKPGQPPKLLIYWASTRESG VPDRFSGSGSGTDFTLTISSLQAEDVAVYYCQQHFNTPFAFGQGTKLEIKSGGGGSEVQLVESGG GLVQPGGSLKLSCAASGFTFNKYAMNWVRQAPGKGLEWVARIRSKYNNYATYYADSVKDRFTISR DDSKNTAYLQMNNLKTEDTAVYYCVRHGNFGNSYISYWAYWGQGTLVTVSSGGGGSGGGGSGGGG SQTVVTQEPSLTVSPGGTVTLTCGSSTGAVTSGYYPNWVQQKPGQAPRGLIGGTKFLAPGTPARF SGSLLGGKAALTLSGVQPEDEAEYYCALWYSNRWVFGGGTKLTVL |
| 318. | MCSP-A9 HL x H2C HL | artificial | nt | CAGGTGCAGCTGGTCCAGTCTGGGGCTGAGGTGAAGAAGCCTGGGGCCTCAGTGAAGGTCTCCTG CAAGGCTTCTGGATACCCCTTCACCGGCTACTACATGCACTGGGTGCGACAGGCCCCTGGACAAG GGCTTGAGTGGATGGGATGGATCAACCCTAACAGTGGTGGCACAAACTATGCACAGAAGTTTCAG GGCAGAGTCACGATTACCGCGGACGAATCTACAGCCACATACATGGAGCTGAGCAGGCTGAGA ATCTGACGACACGGCCGTGTATTACTGTGCGAAATCCTGGGTTCTGGCGGCGGCTCCGGTGGTGT GGTTCTGACATCGTGATGACACAGTCTCCAGACTCCCTGGCTGTGTCTCTGGGCGAGAGGGCCAC CATCAACTGCAAGTCCAGCCAGTCTTATCCAACCTCCAACAATAAGAACTATTAAATTGGT ACCAGCAGAAACCAGGACAGCCTCCTAAGTGCTCATTTACTGGGCATCTACCCGGAATCCGGG GTCCCTGACCGATTCAGTGGCAGCGGGTCTGGGACAGATTTCACTCTCACCATCAGCAGCCTGCA GGCTGAAGATGTGGCGGTTTATTACTGTCAACAGCATTTTAATACTCCGTTCGCTTTTGCCAG GGACCAAGCTGGAGATCAAATCCGGAGGTGGTGGCAGCGGCGGCGGCGGCAGCGGTGGTCTGAGGA GGATTGGTGCAGCCTGGAGGGTCATTGAAACTCTCATGTGCAGCCTCTGAATTGGTTCACCATTCCAGA GTACGCCATGAACTGGGTCCGCCAGGCTCCAGGAAAGGGTTTCAGTGGAAGACAGTTCACCATCTCCAGA GATGATTCAAAAAACACTGCTATCTACAAGATGAACTGCAACAAATGCCACACTGCCTGACAGTGCCGTGTA CTACTGTGTGAGACATGGAACATTCGGTAATAGCTACATATATTCGGCTGGTGTTCTGGCCGCGGCTCCGGCAAG GACTCTGAGACTGTTGTGACTCAGGAACCTTCACTGACCGTTATCACCTGGTGAACAGTCACTCAC TTGTGGCTCCTGACTGGGCTGTTACATCTGGCTACTACCCAAACTGGGTCCAACAAAACCAG GTCAGGCACCCGTGGTCTTGAGGCAAGGCTGCCCTCACCCTCCAGGGGTACGCAGAGATGAGGC AGAATATATTACTGTCTATGGTACAGCAACCGCTGGGTTCCGTGGAGGAACCAAACTGACTG TCCTA |
| 319. | MCSP-A9 HL x F12Q HL | artificial | aa | QVQLVQSGAEVKKPGASVKVSCKASGYPFTGYYMHWVRQAPGQGLEWMGWINPNSGGTNYAQKFQ GRVTITADESTSTAYMELSRLRSDDTAVYYCAKSWVSWFASWGQGTLVTVSSGGGSGGGGSGGG GSDIVMTQSPDSLAVSLGERATINCKSSQSVLSSSNNKNYLNWYQQKPGQPPKLLIYWASTRESG VPDRFSGSGSGTDFTLTISSLQAEDVAVYYCQQHFNTPFAFGQGTKLEIKSGGGGSEVQLVESGG GLVQPGGSLKLSCAASGFTFNSYAMNWVRQAPGKGLEWVARIRSKYNNYVSWNAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 320. | MCSP-A9 HL x F12Q HL | artificial | nt | CAGGTGCAGCTGGTCCAGTCTGGGGCTGAGGTGAAGAAGCCTGGGGCCTCAGTGAAGGTCTCCTG CAAGGCTTCTGGATACCCCTTCACCGGCTACTACATGCACTGGGTGCGACAGGCCCCTGGACAAG GGCTTGAGTGGATGGGATGGATCAACCCTAACAGTGGTGGCACAAACTATGCACAGAAGTTTCAG GGCAGAGTCACGATTACCGCGGACGAATCTACAGCCACATACATGGAGCTGAGCAGGCTGAG ATCTGACGACACGGCCGTGTATTACTGTGCGAAATCCTGGGTTCTGGCGGCGGCTCCGGTGGTGT AAGGAACCTTGACATCGTGATGACACAGTCTCCAGACTCCCTGGCTGTGTCTCTGGGCGAGAGGGTGGT GGTTCTGACATCGTGATGACACAGTCTCCAGACTCCCTGGCTGTGTCTCTGGGCGAGAGGGCCAC |

| SEQ ID NO. | DESIGNATION | SOURCE | TYPE | SEQUENCE |
|---|---|---|---|---|
| | | | | CATCAACTGCGAAGTCCAGCCAGAGTGTCTTATCCAGCTCCAACAATAAGAACTACTTAAATTGGT<br>ACCAGCAGAAACCAGGACAGCCTCCTAAGTTGCTCATTTACTGGGCATCTCCGGGAATCCGGG<br>GTCCCTGACCGATTCAGTGGCAGCGGGTCTGGACAGATTCACTCTCACCATCAGTCGTCTGCAGCCTGAA<br>GGCTGAAGATGTGGCGGTTTATTACTGTCAACAACATTTTAATACTCCGTTCGTTTGGCCAG<br>GGACCAAGCTGGAGATCAAATCCGGAGGTGGTGGATCGGGTGGCGGAGGATCTGGAGGA<br>GGATTGGTGCAGCCTGGAGGGTCCATTGAAACTCTCATGTGCAGCCTCTGGATTCACCTTCAAGT<br>CTACGCCATGAACTGGGTCCGCCAGGCTCCAGGAAAGGGTTTCAGTGGAAACTGGAAGTAATGG<br>GTAAATAATAATTATGCAACATATTATGCCGATTCAGTGAAAGGCCAGTTCACCATCTCCAGA<br>GATGATTCAAAAAACACTTGCCTATCTACAAATGAACAACTTGAAAACTGAGGACACTGCCGTGTA<br>CTACTGTGTGAGACATGGAACTTCGGAGTAATGCTACGTTTCCTGTGGCTTACTGGGCCAAG<br>GGACTCTGGTCACCGTCTCCTCAGGTGGTGGTGGTTCTGGCGGCGGCGGCTCCGGTGGTGGTGGT<br>TCTCAGACTGTTGTGACTCAGGAACCTTCACTCACCGTATCACCTGGTGAACAGTCACTCAC<br>TTGTGCCTCCTCCGACTGGGCTGTTACATCTGGAACTACCCAAACTGGGTCCAACAGAAACCAG<br>GTCAGGCACCCGTGGTCTATAATAGGTGGCAAGGCTGCCCTCACCCTCTCAGGGGTCACGCCAGAGATTC<br>TCAGGCTCCCTGCTTGGAGGCAAGGCTGCCCTCACCCTCTCAGGGGTACAGCCAGAGATGAGGC<br>AGAATATTACTGTGTTCTATGGTACAGCACCGCTGGGTTCCGTGGAGGAACCAAACTGACTG<br>TCCTA |
| 321. | MCSP-A9 HL x I2C HL | artificial | aa | QVQLVQSGAEVKKPGASVKVSCKASGYPFTGYYMHWVRQAPGQGLEWMGWINPNSGGTNYAQKFQ<br>GRVTITADESTSTAYMELSRLRSDDTAVYYCAKSWSWFASWGQGTLVTVSSGGGGSGGGGSGGGG<br>GSDIVMTQSPDSLAVSLGERATINCKSSQSVLSSSNNKNYLNWYQQKPGQPPKLLIYWASTRESG<br>VPDRFSGSGSGTDFTLTISSLQAEDVAVYYCQQHFNTPFAFGQGTKLEIKSGGGGSEVQLVESGG<br>GLVQPGGSLKLSCAASGFTFNKYAMNWVRQAPGKGLEWVARIRSKYNNYATYYADSVKDRFTISR<br>DDSKNTAYLQMNNLKTEDTAVYYCVRHGNFGNSYISYNAYWGQGTLVTVSSGGGGSGGGGSGGGG<br>SQTVVTQEPSLTVSPGGTVTLTCGSSTGAVTSGNYPNWVQQKPGQAPRGLIGGTKFLAPGTPARF<br>SGSLLGGKAALTLSGVQPEDEAEYYCVLWYSNRWVFGGGTKLTVL |
| 322. | MCSP-A9 HL x I2C HL | artificial | nt | CAGTGCAGCTGGTCCAGTCTGGGGCTGAGGTGAAGAAGCCTGGGGCCTCAGTGAAGGTCTCCTG<br>CAAGGCTTCTGGATACCCCTTCACCGGCTACTACATGCACTGGGTGCGACAGGCCCCTGGACAAG<br>GGCTTGAGTGGATGGGATGGATCAACCCTAACAGTGGTGGCACAAACTATGCACAGAAGTTTCAG<br>GGCAGAGTCACGATTACCGCAGACGAATCCACGAGCACAGCCTACATGGAGCTGAGCAGGCTGAG<br>ATCTGACGACACGGCCGTGTATTACTGTGCGAAATCCTGGTCTGGCGGCGGCTTTGCTTCCTGGGGTC<br>AAGGAACCTTGGTCACCGTCTCCTCAGGTGGTGGTGGTTCTGGCGGCGGCGGCTCCGGTGGTGGT<br>GGTTCTGACATCGTGATGACACAGTCTCCAGACTCCCTGGCTGTGTCTCTGGGCGAGAGGGCCAC<br>CATCAACTGCAAGTCCAGCCAGAGTGTCTTATCCAGCTCCAACAATAAGAACTACTTAAATTGGT<br>ACCAGCAGAAACCAGGACAGCCTCCTAAGTTGCTCATTTACTGGGCATCTACCCGGGAATCCGGA<br>GTCCCTGACCGATTCAGTGGCAGCGGGTCTGGGACAGATTCACTCTCACCATCAGCAGCCTGCA<br>GGACCAAGCTGGGATGTAAATCAATCCGGAGGTGGATCGGGTGGCGGAGGATCTGGAGGA<br>GGATTGGTGCAGCCTGGAGGGTCATTGAAACTCTCATGTGCAGCCTCTGGATTCACCTTCAATAA<br>GTATGCCATGAATTGGGTCCGCCAGGCTCCAGGAAAGGGTTTGAATGGGTTGCTCGCATAAGAA<br>GATAGTTCAAAAAACACTTGCCTATCTACAAATGAACAACTGGGAAACTGAGGACACTGCCGTGTA<br>CTACTGTGTGAGACATGGAACTTTCGGTAATAGCTACATATCCTACTGGGGCCAAG<br>GGACTCTGGTCACCGTCTCCTCAGGTGGTGGTGGTTCTGGCGGCGGCTGGTGGTGGT<br>TCTGTGCCTCCTCCGACTGGGCTGTTACATCTGGAACTACCCAAACTGGGTCCAACAAAACCAG<br>GTCAGGCACCCCGTGGTCTATAATAGGTGGCAAGGCTGCCCTCACCCTCTCAGGGGTACAGCCAGATTC<br>TCAGGCTCCCTGCTTGGAGGCAAGGCTGCCCTCACCCTCTCAGGGGTACAGCCAGAGATGAGGC<br>AGAATATTACTGTGTTCTATGGTACAGCAACCGCTGGGTTCGTGGAGGAACCAAACTGACTG<br>TCCTA |

-continued

| SEQ ID NO. | DESIGNATION | SOURCE | TYPE | SEQUENCE |
|---|---|---|---|---|
| 323. | MCSP-C8 HL × I2C HL | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWVSWFASWGQGTLVTVSSGGGSGGGGSGGG GSDIVMTQSPDSLAVSLGERATINCKSSQSVLNSKNNRNYLAWYQQKPGQPPKLLIYWASTRESG VPDRFSGSGSGTDFTLTISGLQAEDVAVYYCQQHYSTPFTFGPGTKVDIKSGGGGSEVQLVESGG GLVQPGGSLKLSCAASGFTFNKYAMNWVRQAPGKGLEWVARIRSKYNNYATYYADSVKDRFTISR DDSKNTAYLQMNNLKTEDTAVYYCVRHGNFGNSYISYNAYWGQGTLVTVSSGGGGSGGGGSGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 324. | MCSP-C8 HL × I2C HL | artificial | nt | CAGGTGCAGCTGGTCCAGTCTGGGGCTGAGGTGAAGAGGCCTGGGGCCTCAATGAAGGTCTCCTG CAAGGCTTCTGGGTACACCTTCACCAACTACTATATACACTGGGTGCGACAGGCCCCTGGACAAG GTCTTGAGTGGATGGGTTGGATCAACCCTAACAGTGGTGCCACAAACTATGCACAGAAGTTCCAG GGCAGAGTCACCATGACCAGGGACACGTCCACATCCACAGTCTACATGGAGCTGAGCAGCCTGAG ATCTGAGGACACGGCCGTGTATTACTGTGCGAAATCCTGGGTCTCCTGGTTTGCTTCCTGGGGTC AAGGAACCCTGGTCACCGTCTCCTCAGGTGGTGGTTCCGGAGGCGGCGGGATCTCGGGAGGGCCAC CATCAACTGCAAGTCCAGTCAGAGTGTTTTAAACAGCAAGAACAATAGGAACTACTTAGCTTGGT ACCAGCAGAAACCAGGACAGCCTCCTAAGCTGCTCATTTACTGGGCATCTACCCGGGAATCCGGG GTCCCTGACCGATTCAGTGGCAGCGGGTCTGGGACAGATTTCACTCTCACCATCAGTAGCCTGCA GGCTGAAGATGTGGCAGTTTATTACTGTCAGCAACATTATAGTACTCCATTCACTTTTGGCCCTG GGACCAAAGTGGATATCAAATCCGGAGGTGGTGGATCGGAGGTCCAGCTGGTGGAGTCTGGAGGA GGATTGGTGCAGCCTGGAGGGTCATTGAAACTCTCATGTGCAGCCTCTGGATTCACCTTCAATAA GTACGCCATGAACTGGGTCCGCCAGGCTCCAGGAAAGGGTTTGAATGGAGTAGCAAGTCCAGACCTGA GATGATTCAAAAAACACTGCTATCTACAAATGCAACTACACAACTGGGAGCTTGCCGTGTA CTACTGTGTGAGACATGGGAACATTCGGTAATAGCTACTACATATCCTACTGGGGCCAAG GGACTCTGGTCACCGTCTCCTCAGGAGAACCTTCACTCACCGTATCACCTGGTGAACAGTCACTCAC TTGTGGCTCCTGACTGGGCTGTTACATCTGGCAACTACCCCAACTGGGTCCAACAAAACCAG GTCAGGCACCCTGCTTGGAGGCAAGGCTGCCCTCACCCCTCCAGGGGTCAGCCAGAGGATGAAGCC TCAGGCTCCCTGCTGGGCGGCAAAGCCGCCCTCACCCTGTCAGGGGTTCCGTGAGGAACCAACTGACTG AGAATATTACTGTGTTCTATGGTACAGCAACCGTGGGTTCCGTGAGGAACCAACTGACTG TCCTA |
| 325. | MCSP-B8 HL × I2C HL | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWVSWFASWGQGTLVTVSSGGGSGGGGSGGG GSDIVMTQSPDSLTVSPGERATINCKSSQSVLNSKNNRNYLAWYQQKPGQPPKLLIYWASTRESG VPDRFSGSGSGTDFTLTIDSLQPEDSATYYCQQHYSTPFTFGQGTRLEIKSGGGGSEVQLVESGG GLVQPGGSLKLSCAASGFTFNKYAMNWVRQAPGKGLEWVARIRSKYNNYATYYADSVKDRFTISR DDSKNTAYLQMNNLKTEDTAVYYCVRHGNFGNSYISYNAYWGQGTLVTVSSGGGGSGGGGSGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 326. | MCSP-B8 HL × I2C HL | artificial | nt | CAGGTGCAGCTGGTCCAGTCTGGGGCTGAGGTGAAGAGGCCTGGGGCCTCAATGAAGGTCTCCTG CAAGGCTTCTGGGTACACCTTCACCAACTACTATATACACTGGGTGCGACAGGCCCCTGGACAAG GTCTTGAGTGGATGGGTTGGATCAACCCTAACAGTGGTGCCACAAACTATGCACAGAAGTTCCAG GGCAGAGTCACCATGACCAGGGACACGTCCACATCCACAGTCTACATGGAGCTGAGCAGCCTGAG ATCTGAGGACACGGCCGTCTATTACTGTGCGAAATCCTGGGTCTCCTGGTTTGCTTCCTGGGGTC AAGGAACCCTGGTCACCGTCTCCTCAGGTGGTGGTTCTGGCGGCGGCGGCTCCGGTGGTGGT GGTTCTGACATCGTGATGACCCAGTCTCCAGACTCCCTGGCTGTGTCTCTGGGCGAGAGGGCCAC |

| SEQ ID NO. | DESIGNATION | SOURCE | TYPE | SEQUENCE |
|---|---|---|---|---|
| | | | | CATCAACTGCAAGTCCAGCAGAGTGTTTTAAACAGCAAGAACAATAGGAACTACTTAGCTTGGT |
| | | | | ACCAGCAGAAACCAGGACAGCCTCCTAAGCTGCTCATTTACTGCTGCATCTCTAACATCTCCGG |
| | | | | GTCCCTGACGATTCAGTGGCAGCGGGTCTGCAGCAACATTATACTCACTCTGCAGATTTCACTG |
| | | | | GCCTGAAGATAGTGCAACTTATTACTGTGCAGCAAGCTATAGTACTCCATTCACTTTTGGCCAG |
| | | | | GGACCAGACTGGAGATCAAACCGGAGGTGTGAGCTGGTGCAGTCTGGAGCTGAGGTGAAGAA |
| | | | | GGATTGGTGCAGCCTGGCAGGGTCCATTGAAACTCTCATGTGCAGCCTCTGGATTCACCTTCAATA |
| | | | | GTAAGGCCATGAACTGGGTCCGCCAGGCTCCAGGAAAGGGTTTGGATGAAAGACAGGTTCACCATCTCCAGA |
| | | | | GATGATTCAAAACTCAACATCTATAGTGCCGATTCAGTGAAGGGCCGATTCACCATCTCCAGA |
| | | | | CTACTGCTGTAGACAGCATGGAACTTCGTATTATCACTGTAGCTACATATCCTACTGGGCCAAG |
| | | | | GGACTCTGGTCACCGTCTCCTCAGGTGGTGTGTTCTGGCGGCGGCGGCTCCGGTGGTGGTGGT |
| | | | | TCTCAGACTGTTGTGACTCAGGAACCTTCACTCTGTCCTGTGACTTCCCTGGAAACGTCACATCAC |
| | | | | TTGTGCTCCGATGGCAGATTATAAGCAATTGTTACAATCTGGCAACTACCCAAACTGGAGCAGGTCCTCCGAGATTC |
| | | | | GTCAGGCACCCCTGTCTAATAGGTCAAGGCTGCCCTCACCCTCAGGGGTACAGCCAGAGGATGAGGC |
| | | | | AGAATATTACTGTGTTCTATGGTACAGCAACCGCTGGGTTCGTGGAGGCAACTGACTG |
| | | | | TCCTA |
| 327. | MCSP-B7 HL x I2C HL | artificial | aa | QVQLVQSGAEVKRPGASMKVSCKASGYTFTNYYIHWVRQAPGQGLEWMGWINPNSGATNYAQKFQ |
| | | | | GRVTMTRDTSTSTVYMELSSLRSEDTAVYYCAKSWVSWFASWGQGTLVTVSSGGGGSGGGGSGGG |
| | | | | GSDIVMTQSPDSLTVSLGERTTINCKSSQSVLNSKNNRNYLAWYQQKPGQPPKLLIYWASTRESG |
| | | | | VPDRFSGSGSGTDFTLTIDSLQPEDIATYYCQQHYSTPFTFGQGTRLEIKSGGGGSEVQLVESGG |
| | | | | GLVQPGGSLKLSCAASGFTFNKYAMNWVRQAPGKGLEWVARIRSKYNNYATYYADSVKDRFTISR |
| | | | | DDSKNTAYLQMNNLKTEDTAVYYCVRHGNFGNSYISYNAYWGQGTLVTVSSGGGGSGGGGSGGGG |
| | | | | SQTVVTQEPSLTVSPGGTVTLTCGSSTGAVTSGNYPNWVQQKPGQAPRGLIGGTKFLAPGTPARF |
| | | | | SGSLLGGKAALTLSGVQPEDEAEYYCVLWYSNRWVFGGGTKLTVL |
| 328. | MCSP-B7 HL x I2C HL | artificial | nt | CAGGTGCAGCTGGTCCAGTCTGGGGCTGAGGTGAAGAGGCCTGGGGCCTCAATGAAGTCTCCTG |
| | | | | CAAGGCTTCTGGTTACACCTTCACCAACTACTACATACACTGGGTGCGACAGGCCCCTGGACAAG |
| | | | | GTCTTGAGTGGATGGGATGGATCAACCCTAACAGTGGTGGCACAAACTATGCACAGAAGTTCCAG |
| | | | | GGCAGAGTCACCATGACCAGGGACACGTCCACGAGCACAGTCTACATGGAGCTGAGCAGCCTGAG |
| | | | | ATCTGAGGACACGGCCGTGTATTACTGTGCGAAATCCTGGGTCTCGGCGGCGGCTTCCTGGGGTC |
| | | | | AAGGAACCTTGGTCACCGTCTCCTCAGGTGGTGGTGGTTCTGGCGGCGGCGGCTCCGGTGGTGGT |
| | | | | GGTTCTGACATCGTGATGACCCAGAGTCCAGACTCCCTGACTGTCTCTGGGGAGAGGACCAC |
| | | | | CATCAACTGCAAGTCCAGCAGTGTTTTAAACAGCAAGAACAATAGGAACTACTTAGCTTGGT |
| | | | | ACCAGCAGAAACCAGGACAGCCTCCTAAGCTGCTCATTTACTGGGCATCTACCAGGGAATCCGG |
| | | | | GCCTGACCGATTCAGTGGCAGCGGGTCTGGGACAGATTTCACTCTCACCATCGATTCCCTGCAG |
| | | | | GGACAGACTGGAGATCAAATCCGGAGGTGGTGGATCGGAAGTGAGCAGTTCCAG |
| | | | | GGATTGGTGCAGCCTGGCGGGTCCTTGAAACTCTCATGTGCAGCCTCTGGATTCACCTTCAATAA |
| | | | | GTAAATAATAATATGGCAACATTATGCACACATTATGCAGTAAGCAGGTTCACCATCTCCAGA |
| | | | | GATGATTCAAAACACTCAACATCTACAATGCACTGGCAGGACACACTGGGCTAACAAAACCAG |
| | | | | CTACTGTGTGAGACATGGAACATTTCGGTAATAGCTACATATCCTACTGGGCCAAG |
| | | | | GGACTCTGGTCACCGTCTCCTCAGGACCTTGTGACTCAGGAGCCCTCCCTGGAACAGTCACACTCAC |
| | | | | TTGTGGCTCCTCAGACTGTTAATAGTGGGACTAAGTTCCTACCCTCTCAGGGGATACCTGCCAGATTC |
| | | | | GTCAGGCACCCCCGTCTGGTCCTTGAGGCAAGGCTGCCCTCACCCTCAGGGGTACAGCCAGAGGATGAGGC |
| | | | | TCAGGCTCCTGCTGTCTATGGTACAGCAACCGCTGGGTTCGTGGAGGCAACTGACTG |
| | | | | TCCTA |

| SEQ ID NO. | DESIGNATION | SOURCE | TYPE | SEQUENCE |
|---|---|---|---|---|
| 329. | MCSP-G8 HL x I2C HL | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWVSWFASWGQQGTLVTVSSGGGGSGGGGSGGG GSDIVMTQSPDSLTVSLGERATINCKSSQSVLNSKNNRNYLAWYQQKPGQPPKLLIYWASTRESG VPDRPSGSGSGTDFTLTIDSLQPEDSATYYCQQHYSTPFTFGQGTRLEIKSGGGSEVQLVESGG GLVQPGGSLKLSCAASGFTFNKYAMNWVRQAPGKGLEWVARIRSKYNNNYATYYADSVKDRFTISR DDSKNTAYLQMNNLKTEDTAVYYCVRHGNFGNSYISYWAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 330. | MCSP-G8 HL x I2C HL | artificial | nt | CAGGTGCAGCTGGTCAGTCCAGTCTGGGGCTGAGGTGAAGAGGCCTGGGGCCTCAATGAAGTCTCCTG CAAGGCTTCTGGGTACACCTTCACCAACTACTATATACACTGGGTGCGACAGGCCCCTGGACAAG GTCTTGAGTGGATGGGTTGGATCAACCCTAACAGTGGTGCCACAAACTATGCACAGAAGTTCCAG GGCAGAGTCACCATGACCAGGGACACGTCCACGAGCACAGTCTACATGGAGCTGAGCAGCCTGAG ATCTGAGGACACGGCCGTGTATTACTGTGCGAAATCCTGGGTCTCCTGGTTCTTCCTGGGGTC AAGGAACCTTGGTCACCGTCTCCAGTGGTGGTGGCTCCAGACTCTGACTGTGTCTCTGGGCGAGGGCCAC CATCAACTGCAAGTCCAGCCAGAGTGTTTTAAACAGCAAGAACAATAGGAACTACTTAGCTTGGT ACCAGCAGAAACCAGGACAGCCTCCTAAGCTGCTCATTTACTGGGCATCTACCCGGGAATCCGGG GTCCCTGACCGATTCAGTGGCAGCGGGTCTGGGACAGATTTCACTCTCACCATCGATTCCTGCA GCCTGAAGATAGTGCAACTTATTACTGTCAGCAATATTATGGTCCAGGTCCAGTCTGCAGTCTGGAGGA GGATTGGTGCAGCCTGGAGGGTCCATTGAAACTCTCATGTGCAGCCTCTGGATTCACCTTCAATAA GTACCCATGAACTGGGTCCGCCAGGCTCCAGGGAAAGGGTTTGAAGAGACAGGTTCACCATCTCCAGA GATGATTCAAAAAACACTGCCTATCTACAAATGAACAGTCTGAAAACTTGAAGACTGAGGACAC CTACTGTGTGAGACATGGAATTCGGTAATAGCTACATATCCTACTGGGCTTACTGGGGCCAAGG GGACTCTGGTCACCGTCTCCTCAGGAACCTTCACTACCGTATCACCCTGGAACAGTCCAACTCAC TCTCAGACTGTTGTGACTCAGGGGCTTGTTACATCTGGACATTCGGAAATCCACCCGGAAACAGAATTC CAGGCACCCGTCCTGCTTGGAGCAAGCTGCCTCACCCTCACCCGCTGGGTGTTCGGTGGAGGACCAAACTGACTG TCAGGCTCCTTGAGGTGTTCTATGGTACAGGAAAGGTTCGGTGGAGGACCAAACTGACTG TCCTA |
| 331. | MCSP-D5 HL x I2C HL | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWVSWFASWGQQGTLVTVSSGGGGSGGGGSGGG GSDIVMTQSPDSLAVSLGERATINCKSSQSVLNSKNNRNYLAWYQQKPGQPPKLLIYWASTRESG VPDRPSGSGSGTDFTLTIDSLQAEDSATYYCQQHYSTPFTFGQGTRLEIKSGGGSEVQLVESGG GLVQPGGSLKLSCAASGFTFNKYAMNWVRQAPGKGLEWVARIRSKYNNNYATYYADSVKDRFTISR DDSKNTAYLQMNNLKTEDTAVYYCVRHGNSYISYWAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 332. | MCSP-D5 HL x I2C HL | artificial | nt | CAGGTGCAGCTGGTCAGTCCAGTCTGGGGCTGAGGTGAAGAGGCCTGGGGCCTCAATGAAGTCTCCTG CAAGGCTTCTGGGTACACCTTCACCAACTACTATATACACTGGGTGCGACAGGCCCCTGGACAAG GTCTTGAGTGGATGGGTTGGATCAACCCTAACAGTGGTGCCACAAACTATGCACAGAAGTTCCAG GGCAGAGTCACCATGACCAGGGACACGTCCACGAGCACAGTCTACATGGAGCTGAGCAGCCTGAG ATCTGAGGACACGGCCGTGTATTACTGTGCGAAATCCTGGGTCTCCTGGTTCTTCCTGGGGTC AAGGAACCTTGGTCACCGTCTCCTCAGGTGGTGGTGGTGGTTCTGGCGGCGGCGGCTCCGGTGGTGGT GGTTCTGACATCGTGATGACCCAGTCTCCTGCCTCCCTGGCTGTGTCTCTGGGCGAGAGGGCCAC |

| SEQ ID NO. | DESIGNATION | SOURCE | TYPE | SEQUENCE |
|---|---|---|---|---|
| | | | | ACCAGCAGAAACCAGGAGCAGCCTCCTAAGCTGCTCATTTACTGGGCATTCACCCGGAATCCGGG<br>GTCCCTGACCGATTCAGTGGCAGCGGGTCTGGGACAGATTTCACTCTCACCATCGATTCCTGCA<br>GGCTGAAGATAGTGCAACTTATTACTGTCAGCAACATTATAGTACTCCATTCACTTTTGGCCAG<br>GGAACCAGAGTGGAGATCAAATCCGAGGTGGTGATCAAGCTGGATCCTGAGCTGACACCTGAAG<br>GGATTGGTGCAGCCTGCAGGGTCTCATTGAAACTCTCATGTGCAAGTTCTCTGATTCACCTTCAATAA<br>GTACGCCATGAACTGGGTCCGCCAGGCTCCAGGGAAGGGTTTGGAATGGGTTGCTCGCATAAGAA<br>GTAATATATATTATGCAACATTATTACTGTGCAAAAACACTGCTCATCTACAAATGAACAACTTGAAAGATCCAGA<br>GATGATTCAAAAACACTGCCTATCTACAAATGAACAACTTGAAAGATCCAGA<br>CTACTGTGTGAGACATGGGAACTTCGGTAATAGCTACATATCCTACTGGGCTTACTGGGCCAAG<br>GGACTCTGGTCACCGTCTCCTCAGGGACTTCCTGGTTCTGCGGCGGCGGCTCCGGTGGTGGT<br>TCTCAGACTGTTGTGACTCAGGAACCTTCACTCCACCGTATCACCTGGTGAACAGTCACACTCAC<br>TTGTGCTCCTGACTGGGCTGTTACATCTGGACTAAGTTCCTGCAACTACCCAAACTGGGTCTACTCCTGCCAGATTC<br>GTCAGGCACCCCGTGGTCTAATAGGTGGGACTAAGTTCCTGCAACTACCCAAACTGGGTACTCCTGCCAGATTC<br>TCAGGCTCCCTGCTTGGAGGACAAGCTGCCCCTCACCCTCTCAGGGTGTTCGGTGAGGCAAGCCAGGATGAAGC<br>AGAATATTACTGTGTTCTATGGTACAGCAGCCTGGGTGTTCGGTGGAGGAACCAAACTGACTG<br>TCCTA |
| 333. | MCSP-F7 HL x I2C<br>HL | artificial | aa | QVQLVQSGAEVKRPGASMKVSCKASGYTFTNYYIHWVRQAPGQGLEWMGWINPNSGATNYAQKFQ<br>GRVTMTRDTSTSTVYMELSSLRSEDTAVYYCAKSWVSWFASWGQCTLVTVSSGGGGSGGGGSGGG<br>GSDIVMTQSPDSLAVSLGERATINCKSSQSVLNSKNNRNYLAWYQQKPGQPPKLLIYWASTRESG<br>VPDRFSGSGSGTDFTLTIDVLQPEDIATYYCQQHYSTPFFGQGTRLEIKSGGGGSEVQLVESGG<br>GLVQPGGSLKLSCAASGFTFNKYAMNWVRQAPGKGLEWVARIRSKYNNYATYYADSVKDRFTISR<br>DDSKNTAYLQMNNLKTEDTAVYYCVRHGNFGNSYISYWAYWGQGTLVTVSSGGGGSGGGGSGGGG<br>SQTVVTQEPSLTVSPGGTVTLTCGSSTGAVTSGNYPNWVQQKPGQAPRGLIGGTKFLAPGTPARF<br>SGSLLGGKAALTLSGVQPEDEAEYYCVLWYSNRWVFGGGTKLTVL |
| 334. | MCSP-F7 HL x I2C<br>HL | artificial | nt | CAGGTGCAGCTGGTCCAGTCTGGGGCTGAGGTGAAGAGGCCTGGGGCCTCAATGAAGGTCTCCTG<br>CAAGGCTTCTGGGTACACCTTCACCAACTACTATATACACTGGGTGCGACAGGCCCCTGGACAAG<br>GTCTTGAGTGGATGGGTTGGATCAACCCTAACAGTGGTGCCACAAACTATGCACAGAAGTTCAG<br>GGCAGAGTCACCATGACCAGGGACACGTCCACGAGCACAGTCTACATGGAGCTGAGCAGCCTGAG<br>ATCTGAGGACACGGCCGTGTATTACTGTGCGAAATCCTGGGTCTCCTGGTTTGCTTCCTGGGGTC<br>AAGGAACCTTGGTCACCGTCTCCTCAGGTGGTGGAGGTTCTGGCGGCGGCGGCTCCGGTGGTGT<br>GGTTCTGACATCGTGATGACCCAGTCTCCAGACTCCCTGGCTGTGTCTCTGGGCGAGAGGGCCAC<br>CATCAACTGCAAGTCCAGCCAGAGTGTTTTAAACAGCAAGAACAATAGGAACTATTAGCTTGGT<br>ACCAGCAGAAACCAGGACAGCCTCCTAAGCTGCTCATTTACTGGGCATCTACCCGGGAATCCGGG<br>GTCCCTGACCGATTCAGTGGCAGCGGGTCTGGGACAGATTTCACTCTCACCATCAGTCCTGCA<br>GCCTGAAGATATTGCAACTTATTACTGTCAGCAACATTATAGTACTCCATTCACTTTTGGCCAGG<br>GAACCAGAGTGGAGATCAAATCCGAGGTGCAGCTGGTGGAGTCTGGGGGAGGCTTGGTACAGCCTGGGGTCTCTGAGA<br>GGATTGGTGCAGCCTGCAGGGTCATTGAAACTCTCTGTGCAGCCTCTGGATTCACCTTCAATAA<br>GTACGCCATGAACTGGGTCCGCCAGGCTCCAGGGAAGGGTTTGGAATGGGTAGCTCGCATAAGAA<br>GTAATATATATTATGCAACATTATTGGGATGGGTCCGCCAGGCTCCAGGGAAGGGTTGAAAGATCCAGA<br>GATGATTCAAAAACACTGCCTATCTACAAATGAACAACTTGAAAGATCCAGA<br>CTACTGTGTGAGACATGGGAACTTCGGTAATAGCTACATATCCTACTGGGCTTACTGGGCCAAG<br>GGACTCTGGTCACCGTCTCCTCAGGGGGTGGTGGAAGGTCTGGCGGCGGCTCCGGTGGTGGT<br>TCTCAGACTGTTGTGACTCAGGAACCTTCACTCCACCGTATCACCTGGTGAACAGTCACACTCAC<br>TTGTGCTCCTGACTGGGCTGTTACATCTGGACTAAGTTCCTGCAACTACCCAAACTGGGTCTACTCCTGCCAGATTC<br>GTCAGGCACCCCGTGGTCTAATAGGTGGGACTAAGTTCCTGCAACTACCCAAACTGGGTACTCCTGCCAGATTC<br>TCAGGCTCCCTGCTTGGAGGCAAGCTGCCCCTCACCCTCTCAGGGGTCAGCCAGGATGAGGC<br>AGAATATTACTGTGTTCTATGGTACAGCAGCCTGGGTGTTCGGTGGAGGAACCAAACTGACTG<br>TCCTA |

| SEQ ID NO. | DESIGNATION | SOURCE | TYPE | SEQUENCE |
|---|---|---|---|---|
| 335. | MCSP-G5 HL x I2C HL | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWSWFASWGQQTLVTVSSGGGGSGGGGSGGGG GSDIVMTQSPDSLAVSLGDRATINCKSSQSVLNSKNNRNYLAWYQQKPGQPPKLLIYWASTRESG VPDRPSGSGSGTDFTLTIDSLQPEDSATYYCQQHYSTPTFGQGTRLEIKSGGGSEVQLVESGG GLVQPGGSLKLSCAASGFTFNKYAMNWVRQAPGKGLEWVARIRSKYNNNYATYYADSVKDRFTISR DDSKNTAYLQMNNLKTEDTAVYYCVRHGNFGNSYISYWAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 336. | MCSP-G5 HL x I2C HL | artificial | nt | CAGGTGCAGCTGGTCCAGTCTGGGGCTGAGGTGAAGAGGCCTGGGGCCTCAATGAAGGTCTCCTG CAAGGCTTCTGGGTACACCTTCACCAACTACTATATACACTGGGTGCGACAGGCCCCTGGACAAG GTCTTGAGTGGATGGGTTGGATCAACCCTAACAGTGGTGCCACAAACTATGCACAGAAGTTCCAG GGCAGAGTCACCATGACCAGGGACACGTCCACGAGCACAGTCTACATGGAGCTGAGCAGCCTGAG ATCTGAGGACACGGCCGTGTATTACTGTGCGAAATCCTGGTCTTCCTGGTTTGCTTCCTGGGGTC AAGGAACCTTGGTCACCGTCTCCAGTGGTGGTGGCGGATCTCCAGGAGGGAAGGAGGCCCAC CATCAACTGCAAGTCCAGCCAGTCTCAAGCTGCTTAAACAGAAGAACAATAGGAACTACTTAGCTTGGT ACCAGCAGAAACCAGGACAGCCTCCTAAGCTGCTCATTTACTGGGCATCTACCCGGGAATCCGGG GTCCCTGACCGATTCAGTGGCAGCGGGTCTGGGACAGATTTCACTCTCACCATCGATTCCTGCA GCCTGAGGATAGTGCAACTATTACTGTCAGGAGGTGGTGGATCCGAGGTCCAGGCTGATTCTCGTCAGCCTCTTGGCCAGG GGACCAAGCTGGAGATCAAATCCGGAGGTCATTGAACTCTCATGTGCAGCCTCTGGATTCACCTTCAATAA GTACGCCATGAACTGGGTCCGCCAGGCTCCAGGAAAGGGTTTGAAATGACAACTTGAAGACTGAGGAG GATGGTGCAGCCTGGAGGGTCCATTATATGCCGATTCAGTGGTAATAGCTACTATATCTCCAGA GTAATAATATAATACACTGCCTATCTCCTCAGGAACCTTCACAAATGAACAACTTGAAAACTTCAATAA GATGATTCAAAAAACACTGGCCTATCTCCTCAGGAACCTTCACAAATGAACAACTTGAAAACTTCAAGA CTACTGTGTAGCGAGACATTCGGTTTATTAGCTACTATATCTCCAGAGTATAGCTACTACTGGGGCCAAG GGACTCTGGTCACCGTCTCCTCAGGAACCTTCACCGTATCACCCGAACAGTCCAACAAAACCAG TCTGAGACTGTTGTGACTCAGGACCTTGTTACATCTGGACTAAGTTCCTCACCCTCCAGAGATTC GTCAGGCACCCCTGCTTGGAGCAAGCTGCCCTCACAGCACGCTGGGTGTTCGGTGGAGGAACCAAACTGACTG TCAGCTCCTCCTGCTTGGAGCAAGCTGCCCTCACAGCACGCTGGGTGTTCGGTGGAGGAACCAAACTGACTG AGAATATTACTGTGTTCTATGGTACAGCAGCGTGGGTGTTCGGTGGAGGAACCAAACTGACTG TCCTA |
| 337. | MCSP-F8 HL x I2C HL | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWSWFASWGQQTLVTVSSGGGGSGGGGSGGGG GSDIVMTQSPDSLTVSLGERATINCKSSQSVLNSKNNRNYLAWYQQKPGQPPKLLIYWASTRESG VPDRPSGSGSGTDFTLTIDSLQAEDSAIYYCQQHYSTPTFGQGTRLEIKSGGGSEVQLVESGG GLVQPGGSLKLSCAASGFTFNKYAMNWVRQAPGKGLEWVARIRSKYNNNYATYYADSVKDRFTISR DDSKNTAYLQMNNLKTEDTAVYYCVRHGNFGNSYISYWAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 338. | MCSP-F8 HL x I2C HL | artificial | nt | CAGGTGCAGCTGGTCCAGTCTGGGGCTGAGGTGAAGAGGCCTGGGGCCTCAATGAAGGTCTCCTG CAAGGCTTCTGGGTACACCTTCACCAACTACTATATACACTGGGTGCGACAGGCCCCTGGACAAG GTCTTGAGTGGATGGGTTGGATCAACCCTAACAGTGGTGCCACAAACTATGCACAGAAGTTCCAG GGCAGAGTCACCATGACCAGGGACACGTCCACGAGCACAGTCTACATGGAGCTGAGCAGCCTGAG ATCTGAGGACACGGCCGTGTATTACTGTGCGAAATCCTGGTCTTCCTGGTTTGCTTCCTGGGGTC AAGGAACCTTGGTCACCGTCTCCAGTGGTGGTGGCGGATCTCCAGGAGGGAAGGAGGCCCAC CATCAACTGCAAGTCCAGCCAGTCTCAAGCTGCTTAAACAGAAGAACAATAGGAACTACTTAGCTTGGT |

| SEQ ID NO. | DESIGNATION | SOURCE | TYPE | SEQUENCE |
|---|---|---|---|---|
| | | | | ACCAGCAGAAACCAGGACAGCCTCCTAAGCTGCTCATTTACTGGGCATTCTCCGGAATCCGGG GTCCCTGACCGATTCAGTGCCAGCGGGTCTCAGCAGCAGATTTCACTCTCACCATCGATTCTGCA GGCTGAAGATAGTGCCAATTTATTACTGTCAGCAACATTATAGTACTCCATTCACTTTTGGCCAG GGAACCAGAGTGGAGATCAAATCCGAGGTGGTGATCAGGAGGTGCAGCTGGTCGAGTCTGGAGGA GGATTGGTCCAGCCTGCAGGGTCTCTGAAACTCTCATGTGCAGCTTCTGGATTCACCTTCAATAA GTACCCATGAATAATTATGCAACATATTACTGTGCAAATGAACAACTGAAAACTCCACCATCCAGA CTACTGTGTGAGACATGGGAACTTCGGTAATAGCTACATATCCTACTGGGCTTACTGGGCCAAG GGACTCTGGTCACCGTCTCCTCAGGAACTTCACCTCACCGTATCACCTGGTGGAACAGTCACTCAC TCTCAGACTGTTGTGACTGGGCCTGCTTACATCTGGAACTACCCAAACTGGTCTCAACAAAACAG TTGTGCTCCTCGACCCCGTGTCAAAGGTGGACTAAGTTCTTCGCGCCGATATCACCTGGAAGTCCTGCAGATTC TCAGGCACCGGAGGCCTGCCTCACCCTCGGACTGGTTCTCGTGTGTCGGTGGTGAGGAATGAGGC AGAATATTACTGTGTTCTATGGTACAGCAGCCTGGGTGTTCGGTGGAGGAACCAAACTGACTG TCCTA |
| 339. | MCSP-G10 HL x I2C HL | artificial | aa | QVQLVQSGAEVKRPGASMKVSCKASGYTFTNYYIHWVRQAPGQGLEWMGWINPNSGATNYAQKFQ GRVTMTRDTSTSTVYMELSSLRSEDTAVYYCAKSWVSWFASWGQCTLVTVSSGGGGSGGGGSGGGG GSDIVMTQSPDSLAVSLGERATINCKSSQSVLSSSNNKNYLNWYQQKPGQPPKLLIYWASTRESG VPDRFSGSGSGTDFTLTISSLQAEDVAVYYCQQHPNTPFAFGQGTKLEIKSGGGGSEVQLVESGG GLVQPGGSLKLSCAASGFTFNKYAMNWVRQAPGKGLEWVARIRSKYNNYATYYADSVKDRFTISR DDSKNTAYLQMNNLKTEDTAVYYCVRHGNFGNSYISYWAYWGQGTLVTVSSGGGGSGGGGSGGGG SQTVVTQEPSLTVSPGGTVTLTCGSSTGAVTSGNYPNWVQQKPGQAPRGLIGGTKFLAPGTPARF SGSLLGGKAALTLSGVQPEDEAEYYCVLWYSNRWVFGGGTKLTVL |
| 340. | MCSP-G10 HL x I2C HL | artificial | nt | CAGGTGCAGCTGGTCCAGTCTGGGGCTGAGGTGAAGAGGCCTGGGGCCTCAATGAAGGTCTCCTG CAAGGCTTCTGGGTACACCTTCACCAACTACTATATACATGGGTGCGACAGGCCCCTGGACAAG GTCTTGAGTGGATGGGTTGGATCAACCCTAACAGTGGTGCCACAAACTATGCACAGAAGTTCCAG GGCAGAGTCACCATGACCAGGGACACGTCCACGAGCACAGTCTACATGGAGCTGAGCAGCCTGAG ATCTGAGGACACGGCCGTGTATTACTGTGCGAAATCTGGGTCTCCTGGTTTGCTTCCTGGGGTC AAGGAACCTTGGTCACCGTCTCCTCAGGTGGTGGTGGTCCCGGCGGGCGGTGCCGGTGGTGT GGTTCTGACATCGTGATGACACAGTCCCAGACTCCCTGGCTGTGTCTCTGGGCGAGAGGCCAC CATCAACTGCAAGTCCAGCCAGAGTGTCTTATCCAGCTCCAACAATAAGAACTACTTAAATTGGT ACCAGCAGAAACCAGGACAGCCTCCTAAGCTGCTCATTTACTGGGCATTACTCCGGGAATCCGGG GTCCCTGACCGATTCAGTGCCAGCGGGTCTGGGACAGATTTCACTCTCACCATCAGCAGCCTGCA GGCTGAAGATGTGGCGGTTTATTACTGTCAGCAACATTTTAATACTCCGTTCGCTTTTGGCCAG GGGACCAAGCTGGAGATCAAATCCGAGGTGCAGCTGGTCGAGTCTGGAGGAGGATTGGTCCAGCCTGGAGGGT CTCTGAAACTCTCATGTGCAGCCTCTGGATTCACCTTCAACAAGTATGCCATGAACTGGGTCCGCCAGG CTCCAGGAAAGGGTTTTGGAATGGGTCGCAATATCCGCAGAGAAGTATAATGACCTCTTGAGAGCC ATCAGCCGGGCTCTGGGGAGATGGGCTGATCAATGCGCCTGAAATCTCTATGTGCAGCCTCAGGATC AACCTGCTCTAATGGCCTATCTGAGACCTCTCAGCTCGCACTATGACAAAATAAGAAGAAGAACTACTTAAATTGT ACCCTGACCGATTCAGTGCCAGCGGGTCTGGGACAGATTTCACTCTCACCATCAGCAGCCTGCA GGACCAAGCTGCAGATATCAAATCCGAGGTGCAGCTGGTCCAGTCTGGGGCTGAGGTGAAGAAG GATTGGTCCAGCCTGCAGGGTCATTGAAACTCTCATGTGAAACTCTCTGATTCACCTTCAACTTTCAATAA GTACCCATGAATAATTATGCAACATACGCCCTATCTTCGGTTAATAGCTACATATCCTACTGGGCCTACTGGGGCCAAG GATGATTCAAAAAACACTGCCTATCTCCAGGAGACATGGAAACTCTAAAGCAACTCTACCGTCAATAA CTACTGTGTGAGACATGGGAACTTCGGTAATAGCTACATATCCTACTGGGCCTACTGGGGCCAAG GGACTCTGGTCACCGTCTCCTCAGGTGGTGGTGGTTCTGGCGGGCGGCGGCTCCGGTGGTGGTGT TCTCAGACTGTTGTGACTCAGGAACCTTCACTCACCGTATCACCTGGAACAGTCACTCAC TTGTGCTCCTCGACCCCGTGTCAAAGGGTGGACTAAGTTCCTCGCCCCGGGTACTCCTGCCAGATTC TCAGGCTCCCTGCTTGGAGGCAAGGCTGCCCTCACCCTCTCAGGGGTCAGCCAGGATGAGGC AGAATATTACTGTGTTCTATGGTACAGCAACCGCTGGGTGTTCGGTGGAGGAACCAAACTGACTG TCCTA |

| SEQ ID NO. | DESIGNATION | SOURCE | TYPE | SEQUENCE |
|---|---|---|---|---|
| 341 | Human CD3ε 1-8 (N-terminus) | human | aa | QDGNEEMG |
| 342 | Saimiri sciureus CD3ε 1-8 (N-terminus) | Saimiri sciureus | aa | QDGNEEIG |
| 343 | Thioate-modified CpG-Oligonucleotide | artificial | nt | TCCATGACGTTCCTGATGCT |
| 344 | MVH1 | artificial | nt | (GC)AGGTGCAGCTCGAGGAGTCAGGACCT |
| 345 | MVH2 | artificial | nt | GAGGTCCAGCTCGAGCAGTCTGGACCT |
| 346 | MVH3 | artificial | nt | CAGGTCCAACTCGAGCAGCCTGGGGCT |
| 347 | MVH4 | artificial | nt | GAGGTTCAGCTCGAGCAGTCTGGGGCA |
| 348 | MVH5 | artificial | nt | GA(AG)GTGAAGCTCGAGGAGTCTGGAGGA |
| 349 | MVH6 | artificial | nt | GAGGTGAAGCTTCTCGAGTCTGGAGGT |
| 350 | MVH7 | artificial | nt | GAAGTGAAGCTCGAGGAGTCTGGGGGA |
| 351 | MVH8 | artificial | nt | GAGGTTCAGCTCGAGCAGTCTGAGCT |
| 352 | MuVHBstEII | artificial | nt | TGAGGAGACGGTGACCGTGGTCCCTTGGCCCCAG |
| 353 | MUVK1 | artificial | nt | CCAGTTCCGAGCTCGTTGTGACTCAGGAATCT |
| 354 | MUVK2 | artificial | nt | CCAGTTCCGAGCTCGTGTTGACGCAGCCGCCC |
| 355 | MUVK3 | artificial | nt | CCAGTTCCGAGCTCGTGCTCACCCAGTCTCCA |
| 356 | MUVK4 | artificial | nt | CCAGTTCCGAGCTCCAGATGACCCAGTCTCCA |
| 357 | MUVK5 | artificial | nt | CCAGATGTGAGCTCGTGATGACCCAGACTCCA |
| 358 | MUVK6 | artificial | nt | CCAGATGTGAGCTCGTCATGACCCAGTCTCCA |
| 359 | MUVK7 | artificial | nt | CCAGTTCCGAGCTCGTGATGACACAGTCTCCA |
| 360 | MuVkHindIII/BsiW1 | artificial | nt | TGGTGCACTAGTCGTACGTTTGATCTCAAGCTTGGTCCC |
| 361 | forward primer | artificial | nt | GATCTGGTCTACACCATCGAGC |
| 362 | reverse primer | artificial | nt | GGAGCTGCTGCTGGCTCAGTGAGG |
| 363 | forward primer | artificial | nt | TTCCAGCTGAGCATGTCTGATGG |
| 364 | reverse primer | artificial | nt | CGATCAGCATCTGGGCCCAGG |

| SEQ ID NO. | DESIGNATION | SOURCE | TYPE | SEQUENCE |
|---|---|---|---|---|
| 365. | forward primer | artificial | nt | GTGGAGCAGTCACTCAGCAGGACC |
| 366. | reverse primer | artificial | nt | GCCTTCACACCCAGTACTGGCC |
| 367. | forward primer | artificial | nt | TCCCGTACGAGATCTGGATCCCAATTGATGGCCGACTCGTGTCTTCACACAGAGG |
| 368. | reverse primer | artificial | nt | AGTGGGTCGACTCACACACCCAGTACTGGCCATTCTTAAGGGCAGGG |
| 369. | forward primer | artificial | nt | GAGGAATTCACCATGCCGCTGCTACTGCTGCCCCTGCTGTGGGCAGGGCCCTGGCTATGG |
| 370. | reverse primer | artificial | nt | GATTTGTAACTGTATTGGTACTTCC |
| 371. | forward primer | artificial | nt | ATTCCGCCTCCTTGGGGATCC |
| 372. | reverse primer | artificial | nt | GCATAGGAGGACATTGAGCTGGATGG |
| 373. | forward primer | artificial | nt | GCACCAACCTGACCTGTCAGG |
| 374. | reverse primer | artificial | nt | AGTGGGTCGACTCACTGGGTCCTGACCTCTGAGTATTCG |
| 375. | V EGFR 3D-E8 | artificial | aa | EVQLLESGGGLVQAGGSLRLSCAASGRTFSTYTMAWFRQAPGKEREFVQGISRSDGGTYDADSVK<br>GRFTISRDNAKNTVYLQMNSLKPEDTAVYFCAAASVKLVYVNPNRYSYWGQGTQVTVSS |
| 376. | V EGFR 3D-E8 CDR1 | artificial | aa | TYTMA |
| 377. | V EGFR 3D-E8 CDR2 | artificial | aa | GISRSDGGTYDADSVKG |
| 378. | V EGFR 3D-E8 CDR3 | artificial | aa | ASVKLVYVNPNRYSY |
| 379. | EGFR 3D-E8 | artificial | nt | GAGGTGCAGCTGCTCGAGAGCGGTGGTGTTCTGGTTCAGGCGGGTGGCAGCCTGCGTCTGAGCTG<br>TGCGGCGAGCGGCCGTACCTTTAGCACCTATGCCATGGCGTGGTTCGTCAGGCACCGGCAAAG<br>AACGTGAATTTGTGCAGGGCATTAGCCGTAGCGATGGCGGCACCTATGATGCCGATAGCGTGAAA<br>GGCCGTTTACCATTAGCCGTGATAACGCGAAAAACACCGTGTATCTGCAGATGAACAGCCTGAA<br>ACCGGAAGATACCGCGGTGTATTTTTGCGCGGCAGCGAGCGTGAAACTGGTGTATGTGAATCCGA<br>ACCGTTATAGCTATTGGGGCCAGGGTACCCAGGTGACCGTTAGCTCC |
| 380. | EGFR 3D-E8 × I2C<br>HL | artificial | aa | EVQLLESGGGLVQAGGSLRLSCAASGRTFSTYTMAWFRQAPGKEREFVQGISRSDGGTYDADSVK<br>GRFTISRDNAKNTVYLQMNSLKPEDTAVYFCAAASVKLVYVNPNRYSYWGQGTQVTVSSGGGGSE<br>VQLVESGGGLVQPGGSLKLSCAASGFTFNKYAMNWVRQAPGKGLEWVARIRSKYNNYATYYADSV<br>KDRFTISRDDSKNTAYLQMNNLKTEDTAVYCVRHGNFGNSYISYWAYNGQGTLVTVSSGGGGSG<br>GGGSGGGGGQTVVTQEPSLTVSPGGTVLTCGSSTGAVTSGNYPNWVQQKPGQAPRGLIGGTKFL<br>APGTPARFSGSLLGGKAALTLSGVQPEDEAEYYCVLWYSNRWVFGGGTKLTVL |
| 381. | EGFR 3D-E8 × I2C<br>HL | artificial | nt | GAGGTGCAGCTGCTCGAGAGCGGTGGTGTTCTGGTTCAGGCGGGTGGCAGCCTGCGTCTGAGCTG<br>TGCGGCGAGCGGCCGTACCTTTAGCACCTATGCCATGGCGTGGTTTCGTCAGGCACCGGCAAAG<br>AACGTGAATTTGTGCAGGGCATTAGCCGTAGCGATGGCCACCTATGATGCCGATAGCGTGAAA<br>GGCCGTTTTACCATTAGCCGTGATAACGCGAAAAACACCGTGTATCTGCAGATGAACAGCCTGAA<br>ACCGGAAGATACCGCGGTGTATTTTGCGCGGCAGCGAGCGTGAAACTGGTGTATGTGAATCCGA<br>ACCGTTATAGCTATTGGGGCCAGGGCACCCAGGTGACCGTGACCGTTAGCTCCGGAGGTGGTGG<br>GTGCAGCTGTCGAGTCTGGAGGAGGATTGGTGCAGCCTGGAGGGTCATTGAAACTCTCATGTGC<br>AGCCTCTGGATTCACCTTCAATAAGTACGCCATGAACTGGGTCCGCCAGGCTCCAGGAAAGGGTT |

| SEQ ID NO. | DESIGNATION | SOURCE | TYPE | SEQUENCE |
|---|---|---|---|---|
| | | | | TGGAATGGGTGCTGCTGCAATAAGAGTAAATATAATAATTATGCAACATATTATGCGATTCAGTG<br>AAAGACAGGTTCACCATTCTCCAGAGATGATTCAAAAAACACTGCCTATCTACAAACAACTT<br>GAAAACTGAGGACACTGCCGTACTACTGTGAGACATGGAACTTCGGTATAGCTACATAT<br>CCTACTGGGCTTACTGGGCAAGGACTCTGGTTCACCGTCTGTAACTGGCTGTGGTTCTGGC<br>GGCGCGGCCTCCGGTGGTGGTGGCTGTTCAGACTTGTGACTGGTGTCAGGAACCTTCACTACCGTATC<br>ACCTGGTGGAACAGTCACTCACTTGTGCTCTCGACTGTGTTACATCTGGCAACTACC<br>CAAACTGGTCCAACAAAACCAGGTCAGGCACCCAGATTCTGAGGCAAGCTGCCTCACCCTC<br>GCCCCGGTACTCCTGCCAGATTCTCAAGGTCAAGGTCTAATAGGTGGACTAAGTTCCTC<br>AGGGGATAGCCAGGATGAGGCAGAAATATTACTGTGTTCTATGGTACAGCACCGCTGGGTGT<br>TCGTGGAGGAACCAAACTGACTGTCCTA |
| 382. | EGFR 3D-E8 x H2C HL | artificial | aa | EVQLLESGGGLVQAGGSLRLSCAASGRTFSTYTMAWFRQAPGKEREFVQGISRSDGGTYDADSVK<br>GRFTISRDNAKNTVYLQMNSLKPEDTAVFCAAASVKLVYVNPRYSYWGQGTQVTVSSGGGSE<br>VQLVESGGGLVQPGGSLKLSCAASGFTFNKYAMNWVRQAPGKGLEWVARIRSKYNNYATYYADSV<br>KDRFTISRDDSKNTAYLQMNNLKTEDTAVYCVRHGNFGNSYISYWAYWGQGTLVTVSSGGGGSG<br>GGGSGGGGSQTVVTQEPSLTVSPGGTVTLTCGSSTGAVTSGYYPNWVQQKPGQAPRGLIGGTKFL<br>APGTPARFSGSLLGGKAALTLSGVQPEDEAEYYCALWYSNRWVFGGGTKLTVL |
| 383. | EGFR 3D-E8 x H2C HL | artificial | nt | GAGGTGCAGCTGCTCGAGAGCGGTGGTCTGGTTCAGGCGGTGGCAGCCTGCGTCTGAGCTG<br>TGCGGCGAGCGGCCGTACCTTAGCACTATACCATGGCGTGGTTTCGTCAGGCACCGGGCAAAG<br>AACGTGAATTTGTCGAGCATTAGCCGTAGCGATGGCGGCACCTATGATGCGGATAGCGTGAAA<br>GGCCGTTTACCATTAGCCGTGATAACGCGAAAAACACCGTATCTGCAGATGAACAGCCTGAA<br>ACCGAAGATACCGCCGGTGTATTTTGCGCGGCCAGCCAGCGAGCGCGTTACCTCTGAAACTGTGTATGTGAAACTGGAACTCTGGA<br>ACCTTATAGCTATTGGGCTGGAGGAGGATTGGTGCAGCGTGACCGTGAGCGTGATGAGGAGGGT<br>GTGCAGCTGGTCGAGCTCGGAGGAGGACTGGTGCAGCCTGGAGGCTCATTGAAACTCATGGC<br>AGCCTCTGGATTCACCTTCAATAAGTACGCCATGAACTGGTGCGCGCAGGCTCCAGGAAAGGGT<br>TGGAATGGGTTGCTCGCATAAGAAGTAAATATATAATTATGCAACACTATACACTACAAAATGAACACTT<br>AAAGACAGGTTCACCATTCTCCAGAGATGATTCAAAAAACACTGGGAACATGGGAAGCAATGGAACCT<br>CCTACTGGGCTTACTGGGCAAGGACTCTGGTTCACCGTCTCCTCAGGTGGTGGTTCTGGC<br>GGCGGCGCCTCTGGAACAGTCACTCACTTGTCCGGCTCAGGAACCCTGTTAATTAGGTGGGACTAAGTTCC<br>GCCCCCGGTACTCCTGCAAGATTCTCAAGGTCCTCAGGTCTAATAGGTGGGACTAAGTTCCTC<br>AGGGGATATAGCCAGGATGAGCCAGAAATATTACTGTGCTCTATGTACAGCACCGCTGGGTGT<br>TCGGTGGAGGAACCAAACTGACTGTCCTA |
| 384. | EGFR 3D-E8 x F12Q HL | artificial | aa | EVQLLESGGGLVQAGGSLRLSCAASGRTFSTYTMAWFRQAPGKEREFVQGISRSDGGTYDADSVK<br>GRFTISRDNAKNTVYLQMNSLKPEDTAVFCAAASVKLVYVNPRYSYWGQGTQVTVSSGGGSE<br>VQLVESGGGLVQPGGSLKLSCAASGFTFNSYAMNWVRQAPGKGLEWVARIRSKYNNYATYYADSV<br>KGRFTISRDDSKNTAYLQMNNLKTEDTAVYYCVRHGNFGNSYVSWWAYWGQGTLVTVSSGGGGS<br>GGGSGGGGSQTVVTQEPSLTVSPGGTVTLTCGSSTGAVTSGNYPNWVQQKPGQAPRGLIGGTKFL<br>APGTPARFSGSLLGGKAALTLSGVQPEDEAEYYCVLWYSNRWVFGGGTKLTVL |
| 385. | EGFR 3D-E8 x F12Q HL | artificial | nt | GAGGTGCAGCTGCTCGAGAGCGGTGGTCTGGTTCAGGCGGTGGCAGCCTGCGTCTGAGCTG<br>TGCGGCGAGCGGCCCGTACCTTTAGCACCTATACCATGGCGTGGTTTCGTCAGGCACCGGGCAAAG<br>AACGTGAATTTGTCGAGCATTAGCCGTAGCGATGGCGGCACCTATGACGCGGATAGCGTGAAA<br>GGCCGTTTTACCATTAGCCGTGATAACGCGAAAAACACCGTATCTGCAGATGAACAGCCTGAA<br>ACCGAAGATACCGCCGGTGTATTTTGCGCGGCAGCGAGCGTTAGCTCGATGAATGTGAACTGCGA<br>ACCGTTATAGCTATTGGGCTGGAGGAGGATTGGTGCAGCCTGGAGGCTCATTGAAACTCATGTCC<br>GTGCAGCTGGTCGAGTCTGGAGGAGGACTGGTGCAGCCTGGAGGCTCATTGAAACTCTCATGTGC |

-continued

| SEQ ID NO. | DESIGNATION | SOURCE | TYPE | SEQUENCE |
|---|---|---|---|---|
| | | | | AGCCTCTGGATTCACCTTCAATAGCTACGCCATGAACTGGTCCGCCAGGCTCCAGGAAGGGTT<br>TGGAATGGGTTGCTCGCCATAAGAAGCTAAATATAATATCAAAAACTGCCTATCTACAAATGCCGATTCAGTG<br>AAAGGCAGGTTCACCATCTCCAGAGATGATTCAAAAAACACTGCCTATCTACAAATGAACAACTT<br>GAAAACTGAGGACACTGCCGTACTACTGTGTGAGACATGGGAACTTCGGTATAGCTACGTTT<br>CCTGGTGGCTTACTGGGGCCAAGGGACTCTGGTCACCGTCTCGAGTGTGGTGGTTCTGGC<br>GGCGGCGGCTCCGGTGGTGGTGGTTCTCAGACTGTTGTGACTCAGGAACCTTCACTCACCTATC<br>ACCTGGTGAACAGTCACACTCCACTTGTGCCTCTCGACTGGGCTGTTACATCTGGACTACCC<br>CAAACTGGGTCCAACAAAAACCAGTCAGGCACCCCGTTGCTTAATAGTGGGACTAAGTTCCTC<br>GCCCCCGGTACTCCTGCCGAATTCTCAGGCTCCGCTTGGAGGCAAGGCTGCCTCACCCCTCC<br>AGGGTACAGCCAGAGATGCAGAGAATATTACTGTGTTCTATGGTACAGCACCGCTGGGTGT<br>TCGGTGGAGGAACCAAACTGACTGTCCTA |
| 386. | V EGFR 3D-D12 | artificial | aa | EVQLLESGGGSVQTGGSLRLTCAASGRTSRSYGMGWFRQAPGKEREFVSGISWRGDSTGYADSVK<br>GRFTISRDNAKNTVDLQMNSLKPEDTAIYYCAAAAGSAWYGTLYEYDYWGQGTQVTVSS |
| 387. | V EGFR 3D-D12 CDR1 | artificial | aa | SYGMG |
| 388. | V EGFR 3D-D12 CDR2 | artificial | aa | GISWRGDSTGYADSVKG |
| 389. | V EGFR 3D-D12 CDR3 | artificial | aa | AAGSAWYGTLYEYDY |
| 390. | V EGFR 3D-D12 | artificial | nt | GAGGTGCAGCTGCTCGAGAGCGGTGGTGTAGCGTGCAGACCGGCTGTTCGTCAGGCACCGGCAAAG<br>TGCGGTCGAGCGGTCGTACCAGCTCGATAAGCTATGGCCATGGCCAGTCTATAGCGGATAGCCAGGAA<br>AACTGAATTTGTGAGCGGCCATTAGCTGCGCGTGCAAATACCGTGATCTCAGATGCAACAGCCTGAA<br>GGCCGTTTTACCATTAGCCGTGATAACCGCAAAACCGTGATCTCAGATGAACAGCCTGAA<br>ACCGGAAGATACCGCGATTATTATGCGCGGCAGCGGCGTGGTAGCGCGTGGTATGGCACCCTGT<br>ATGAATATGATTATTGGGGCCAGGCACCCCAGGTGACCGTTAGCTCC |
| 391. | V EGFR 3D-D12 x I2C HL | artificial | aa | EVQLLESGGGSVQTGGSLRLTCAASGRTSRSYGMGWFRQAPGKEREFVSGISWRGDSTGYADSVK<br>GRFTISRDNAKNTVDLQMNSLKPEDTAIYYCAAAAGSAWYGTLYEYDYWGQGTQVTVSSGGGGSE<br>VQLVESGGGLVQPGGSLKLSCAASGFTFNKYAMNWVRQAPGKGLEWVARIRSKYNNYATYYADSV<br>KDRFTISRDDSKNTAYLQMNNLKTEDTAVYYCVRHGNFGNSYISYWAYWGQGTLVTVSSGGGGSG<br>GGGSGGGGSQTVVTQEPSLTVSPGGTVTLTCGSSTGAVTSGNYPNWVQQKPGQAPRGLIGGTKFL<br>APGTPARFSGSLLGGKAALTLSGVQPEDEAEYYCVLWYSNRWVFGGGTKLTVL |
| 392. | V EGFR 3D-D12 x I2C HL | artificial | nt | GAGGTGCAGCTGCTCGAGAGCGGTGGTGTAGCGTGCAGACCGGCTGTCCTGCTCGACCTG<br>TGCGGCGAGCGGTCGTACCAGCTCGTAGTAATGGCCATGGCCAGTCTGTTCGTCAGGCACCGGGCAAAG<br>AACTGAATTTGTGAGCGGCCATTAGCTGCGCATAGCGGGCATAGCCGCTATGCCGCTATAGCGGATAGCCTGAAA<br>GGCCCGTTTTACCATTAGCCGTGATAACCGCAAAACCGCTATGCGGATCTCAGATGAACAGCCCTGT<br>ACCGGAAGATACCGCGATTATTATGCGCGGCAGCGGCGTTAGCTGCGTTAGCTGGGATGGCACCCTGT<br>ATGAATATGATTATTGGGGCCAGGCACCCCAGGTGACCGTTAGCTCCGGAGGTGTGAACTCTCATGTGC<br>GTGCAGCTGGTCGAGTCTGGAGGAGGATTGGTGCAGCCTGGAGGGTCATTGAAACTCTCATGTGC<br>AGCCTCTGGATTCACCTTCAACAAGTATGCAATGAATTGGGTCCGCCAGGCTCCAGGAAAGGGTT<br>TGGAATGGGTTGCTCGCATAAGAAGTAAATAAATTATGCAACATATTATGCCGATTCAGTG<br>AAAGACAGGTTCACCATCTCCAGAGATGATTCAAAAAACTGCCTATCTGCAAATGAACAACTT<br>GAAAACTGAGGACACTGCCGTATACTGTGTGAAATGGGGCCTCCCTCTCACCGAGACACGCCCTGAG<br>CCTACTGGGCTTACTGGGGCCAAGGGACCCTGGTCACCGTCTCCTCAGGTGGTGGTTCTGGC<br>GGCGGCGGCTCCGGTGGTGGTGGTTCTCAGACTGTTGTGACTCAGGAACCTTCACTCACCTATC |

| SEQ ID NO. | DESIGNATION | SOURCE | TYPE | SEQUENCE |
|---|---|---|---|---|
| | | | | ACCTGGTGGAACAGTCACACTCACTTGTGCTCTCGACTGGGCTGTTACATCTGGCAACTACC CAAACTGGGTCCAACAAAAACCAGTTCAGGCACCCTCAGGCTCTGAGGCAAGCTGCCTAAGTTCCTC GCCCCCGGTACTCCTGCCAGATTCTGAGGCAGAATTAGGCGACCAAGCTGCCCTACCACCGCTGGGTGT AGGGGTACAGCCAGGATGAGGCAGAATATTACTGTGTTCTATGGTACAGCAACCGCTGGGTGT TCGGTGGAGGAACCAAACTGACTGTCCTA |
| 393. | V EGFR 3D-D12 x H2C HL | artificial | aa | EVQLLESGGGSVQTGGSLRLTCAASGRTSRSYGMGWFRQAPGKEREFVSGISWRGDSTGYADSVK GRFTISRDNAKNTVDLQMNSLKPEDTAIYYCAAAAGSAWYGTLYEYDYWGQGTQVTVSSGGGGSE VQLVESGGGLVQPGGSLKLSCAASGFTFNKYAMMWVRQAPGKGLEWVARIRSKYNNYATYYADSV KDRFTISRDDSKNTAYLQMNNLKTEDTAVYYCVRHGNSYISYWAYWGQGTLVTVSSGGGGSG GGGSGGGGSQTVVTQEPSLTVSPGGTVLTLCGSSTGAVTSGYYPNWVQQKPGQAPRGLIGGTKFL APGTPARFSGSLLGGKAALTLSGVQPEDEAEYYCALWYSNRWVFGGGTKLTVL |
| 394. | V EGFR 3D-D12 x H2C HL | artificial | nt | GAGGTGCAGCTGCTCGAGAGCGGTGGTGTAGCGTGCAGACCGGCGGTAGCCTCGCTCTGACCTG TGCCGCGAGCGGTCGTACCAGCCGGTACAGCCGTATGCGGCGTTCGTCAGGCACCGGCAAAG AACTGGAATTTGTGAGCGGCATTAGCTGGCGTGGCAGCACCCCGGGATACGCAGATGCTGAAA GGCCGTTTTACCATTAGCCGTGATAACGCGAAAAACACCGTGGATCTGCAGATGAACAGCCTGA ACCGGAAGATACCGCGATTTATTATTGCGCGGCACGGTAGCGCGGTTATGGCAACCTGT ATGAATATGATTATGGCCAGGGAGGATTGGTCGACGCTAGCTCCGAGGGTCATTGAAACTCATGTGC AGCCTCTGGATTCCAACCTTCAATAAGAAGTACACCATGGCTCCGCCAGGCTCCGCGATTCAGTG TGGAATGGTTGCTCGCATAAGAAGTAAATATTACAACATATTATGCCGATTCAGTG AAAGACAGGTTCACCATCTCAGAGATGATTCAAAAAAACTGCCTATCTCGGTAATAGCTACATAT GAAAACTGAGGACTGGGCTTACTGGGCCGTGTCTCTCTCAGGTGGTGGTTCTGGC CCTACTGGGTCCGGTGGTGGTTCTGGCGTGTCTCAGATCTGTGTGACTCCAGAACCTTCACTCAGCTATC ACCTGGTGAACAGTCACTTGTGCTCTCGACTGGGCTGTTACATCTGGCTACTACC CAAACTGGGTCCAACAAAAACCAGTTCAGGCACCCTCAGGCTCTGAGGCAAGCTGCCTAAGTTCCTC GCCCCCGGTACTCCTGCCAGATTCTGAGGCAGAATATTACTGTGCTCTATGGTACAGCAACCGCTGGGTGT TCGGTGGAGGAACCAAACTGACTGTCCTA |
| 395. | V EGFR 3D-D12 x F12Q HL | artificial | aa | EVQLLESGGGSVQTGGSLRLTCAASGRTSRSYGMGWFRQAPGKEREFVSGISWRGDSTGYADSVK GRFTISRDNAKNTVDLQMNSLKPEDTAIYYCAAAAGSAWYGTLYEYDYWGQGTQVTVSSGGGGSE VQLVESGGGLVQPGGSLKLSCAASGFTFNSYAMMWVRQAPGKGLEWVARIRSKYNNYATYYADSV KGRFTISRDDSKNTAYLQMNNLKTEDTAVYYCVRHGNFGNSYVSWWAYWGQGTLVTVSSGGGGSG GGGSGGGGSQTVVTQEPSLTVSPGGTVLTLCGSSTGAVTSGNYPNWVQQKPGQAPRGLIGGTKFL APGTPARFSGSLLGGKAALTLSGVQPEDEAEYYCVLWYSNRWVFGGGTKLTVL |
| 396. | V EGFR 3D-D12 x F12Q HL | artificial | nt | GAGGTGCAGCTGCTCGAGAGCGGTGGTGTAGCGTGCAGACCGGCGGTAGCCTCGCTCTGACCTG TGCCGCGAGCGGTCGTACCAGCCGGTAGCATGGGCGTGCATGGAGCGTTCGTCAGGCACCGGCAAAG AACTGGAATTTGTGAGCGGCATTAGCTGGCGTGGCAGCACCCCGGGTATGCGGATAGCGTGAAA GGCCGTTTTACCATTAGCCGTGATAACGCGAAAAACACCGTGGATCTGCAGATGAACAGCCTGAA ACCGGAAGATACCGCGATTTATTATTGCGCGGCAGCCGGTAGCGCGGTTATGGCACCCTGT ATGAATATGATTATGGCCAGGGAGGATTGGTCGACGGTGTGCAGGTGGTGTAGACTCATGTGC AGCCTCTGGATTCCACCTCAATAGCTACGCCATGCAGCAACCTGGTCCGCCAGGCTCCGCAGGAAGGGT TGGAATGGTTGCTCGCATAAGAAGTAAATATTACAACACTGCCTATCTACAAATGAACAACTT AAAGGCAGGTTCACCATTCTCAGAGATACTGTGAGACATGGAACTTCGGTAATAGCTACGTTT GAAAACTGAGGACTGGGCTTACTGGGCCGTCTCCAGGGTACATGGAACTTCGGTAATAGCTACGTTT CCTGGTGGGCTTACTGGGCCAGGGTACACTCCTCAGGTGGTGGTTCTGGC |

| SEQ ID NO. | DESIGNATION | SOURCE | TYPE | SEQUENCE |
|---|---|---|---|---|
| 397. | V CD3 3D-H11 | artificial | aa | GGCGCGGCTCCGGTGGTGGTTCTCAGACTGTTGTGACTCAGGAACCTTCACTCACCGTATC ACCTGGTGGAACAGTCACACTCACTTGTGCTCTCTCGACTGGGCTGTTTACATCTGGCAACTACC CAAACTGGTCCAACAAAAACCAGGTCAGGCACCCCGTGCTTAATAGGTGGACTAAGTTCCTC GCCCCCGGTACTCCTGCCAGATTCTCAGGCTCCAAGGCTTGGAGGCAAGGCTGCCCCTCACCCTCTC AGGGGTACAGCCAGAGGATGAGGCAGAGAATATTACTGTTCTTATGGTACAGACCGCTGGGTGT TCGGTGGAGGAACCAAACTGACTGTCCTA |
| 398. | V CD3 3D-H11 CDR1 | artificial | aa | EVQLLEEVQLVESGGGLVQPGGSLRLSCAASGFTFDDYGMSWVRQAPGKWLEWVSDISWNGGSTY YADSVKGRFTISRDNAENTLYLQMNSLKPDDTAVYYCAKMGEGWGANDYWGQGTQVTVSS |
| 399. | V CD3 3D-H11 CDR2 | artificial | aa | DYGMS |
| 400. | V CD3 3D-H11 CDR3 | artificial | aa | DISWNGGSTYYADSVKG |
| 401. | V CD3 3D-H11 | artificial | aa | MGEGWGANDY |
| | | artificial | nt | GAGGTGCAGCTGCTCGAGGAGGTCCAGCTGGTGGAGTCTGGGGGAGGCTTGGTCAGCCTGGGGG GTCTCTGAGACTCTCCTGTGCAGCCTCTGGATTCACTTTTGATGATTATGGCATGAGCTGGGTCC GACAGGCTCCAGGGAAGTGGCTGGAGTGGGTCTCAGATATTAGCTGGAATGGTGTAGCACATAC TATGCAGACTCCGTGAAGGGCCGGTTCACCATCTCCAGAGACAACGCCGAGAACACGCTGTATCT GCAAATGAACAGCCTGAAACTGACGACACGGGCCGTGTATTACTGTGCAAAATGGGTGAAGGGG GATGGGGTGCAAATGACTACTGGGGCCAGGGACCCAGGTCACCGTCTCCTCC |
| 402. | 5' EGFR AG XbaI | artificial | nt | GGTCTAGAGCATGCGACCCTCCGGACGGCCGG |
| 403. | 3' EGFR AG SalI | artificial | nt | TTTTAAGTCGACTCATGCTCCAATAAATTCACTGCT |
| 404. | Forward primer | artificial | nt | CGCTCTGCCCGCCGGCAGTCGGGC |
| 405. | Reverse primer | artificial | nt | CCGTCTTCCTCCATCTCATAGC |
| 406. | Forward primer | artificial | nt | ACATCCGGAGGTGACAGATCACGGCTCGTGC |
| 407. | Reverse primer | artificial | nt | CAGGATATCCGAACGATGTGGCGCCTTCGC |
| 408. | 5'-VHHa-XhoI | artificial | nt | CTG ACG CTC GAG GAG GTG CAG CTG GTG GAG TCT GG |
| 409. | 5'-VHHb-XhoI | artificial | nt | CTG ACG CTC GAG CAG GTR CAG CTG GTG GAG TCT GG |
| 410. | 5'-VHHc-XhoI | artificial | nt | CTG ACG CTC GAG CAG GTA AAG CTG GAG TCT GG |
| 411. | 5'-VHHd-XhoI | artificial | nt | CTG ACG CTC GAG GAT GTG CAG CTG GTG GAG TCT GG |
| 412. | 5'-VHHe-XhoI | artificial | nt | CTG ACG CTC GAG GCC GTG CAG CTG GTG GAT TCT GG |
| 413. | 5'-VHHf-XhoI | artificial | nt | ACG CTC GAG GCG GTG CAG CTG GTG GAG TCT GG- |
| 414. | 5'-VHH-LP-A-XhoI | artificial | nt | CTG ACG CTC GAG GAG GTG CAG CTG CAG GCG TCT G |
| 415. | 5'-VHH-LP-B-XhoI | artificial | nt | CTG ACG CTC GAG GAT GTS CAG CTG CAG GCG TCT G |

-continued

| SEQ ID NO. | DESIGNATION | SOURCE | TYPE | SEQUENCE |
|---|---|---|---|---|
| 416. | 5'-VHH-LX-I-XhoI | artificial | nt | CTG ACG CTC GAG CAG CTG GTG CAG TCT GG |
| 417. | 5'-VHH-LX-II-XhoI | artificial | nt | CTG ACG CTC GAG CAG GTC ACC TTG AAG GAG TCT GG |
| 418. | 5'-VHH-LX-III-XhoI | artificial | nt | CTG ACG CTC GAG CAG CAG GTG CAG CTG GAG TCG GG |
| 419. | 5'-VHH-LG-1-XhoI | artificial | nt | CTG ACG CTC GAG CAG CAG CTG TCT GGG GG |
| 420. | 3'-VHHG2-BsiWI-SpeI | artificial | nt | CTG ACG ACT AGT CGT AGT ACG TTG GGG TAT CTT GGG TTC TG |
| 421. | 3'-VHHG3-BsiWI-SpeI | artificial | nt | CTG ACG ACT AGT CGT ACG TAC TTC ATT CGT TCC TGA VGA G |
| 422. | 3'-VHH-LP-G2a-BsiWI-SpeI | artificial | nt | CTG ACG ACT AGT CGT ACG TTG TGG TTT TGG TGT CTT GGG TTC |
| 423. | 3'-VHH-LP-dirA-BsiWI-SpeI | artificial | nt | CTG ACG ACT AGT CGT AGT TGA GGA GAC GGT GAC CTG GGT CC |
| 424. | 3'-VHH-LG-dir1-BsiWI-SpeI | artificial | nt | CTG ACG ACT AGT CGT ACG GGT GAC CTG GGT CCC CTG GC |
| 425. | N-termina 1-27 + additional C at position 28 | artificial | aa | QDGNEEMGGITQTPYKVSISGTTVILTC |
| 426. | Flag-tag | artificial | aa | YKDDDDK |
| 427. | Macaca fascicularis CD3epsilon 1-27 | Macaca fascicularis | aa | QDGNEEMGSITQTPYQVSISGTTILTC |
| 428. | Macaca fascicularis CD3epsilon 1-27 | Macaca fascicularis | aa | QDGNEEMGSITQTPYQVSISGTTVILT |
| 429. | Macaca mulatta CD3epsilon 1-27 | Macaca mulatta | aa | QDGNEEMGSITQTPYHVSISGTTVILT |

SEQUENCE LISTING (436 sequences)

SEQ ID NO: 1 - protein, 105 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 2 - protein, 27 aa, Homo sapiens
QDGNEEMGGITQTPYKVSISGTTVILT

SEQ ID NO: 3 - protein, 96 aa, Callithrix jacchus
QDGNEEMGDTTQNPYKVSISGTTVTLTCPRYDGHEIKWLVNSQNKEGHEDHLLLEDFSEMEQSGYYACLSKETPAEEASHYLYLKARVCENCVEVD

SEQ ID NO: 4 - protein, 27 aa, Callithrix jacchus
QDGNEEMGDTTQNPYKVSISGTTVTLT

SEQ ID NO: 5 - protein, 96 aa, Saguinus oedipus; identical to SEQ ID NO: 3

SEQ ID NO: 6 - protein, 27 aa, Saguinus oedipus
QDGNEEMGDTTQNPYKVSISGTTVTLT

SEQ ID NO: 7 - protein, 96 aa, Saimiri sciureus
QDGNEEIGDTTQNPYKVSISGTTVTLTCPRYDGQEIKWLVNDQNKEGHEDHLLLEDFSEMEQSGYYACLSKETPTEEASHYLYLKARVCENCVEVD

SEQ ID NO: 8 - protein, 27 aa, Saimiri sciureus
QDGNEEIGDTTQNPYKVSISGTTVTLT

SEQ ID NO: 9 - protein, 14 aa, Artificial Sequence
  CDR-L1 of F6A
GSSTGAVTSGYYPN

SEQ ID NO: 10 - protein, 7 aa, Artificial Sequence
  CDR-L2 of F6A
GTKFLAP

SEQ ID NO: 11 - protein, 9 aa, Artificial Sequence
  CDR-L3 of F6A
ALWYSNRWV

SEQ ID NO: 12 - protein, 5 aa, Artificial Sequence
  CDR-H1 of F6A
IYAMN

SEQ ID NO: 13 - protein, 19 aa, Artificial Sequence
  CDR-H2 of F6A
RIRSKYNNYATYYADSVKS

SEQ ID NO: 14 - protein, 14 aa, Artificial Sequence
  CDR-H3 of F6A
HGNFGNSYVSFFAY

SEQ ID NO: 15 - protein, 125 aa, Artificial Sequence
  VH of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 16 - DNA, 375 bp, Artificial Sequence
  VH of F6A
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctca

SEQ ID NO: 17 - protein, 109 aa, Artificial Sequence
  VL of F6A
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 18 - DNA, 327 bp, Artificial Sequence
  VL of F6A
cagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 19 - protein, 125 aa, Artificial Sequence
  VH-P of F6A
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 20 - DNA, 375 bp, Artificial Sequence
  VH-P of F6A
gaggtgcagctgctcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctca

SEQ ID NO: 21 - protein, 109 aa, Artificial Sequence
  VL-P of F6A
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 22 - DNA, 327 bp, Artificial Sequence
  VL-P of F6A
gagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 23 - protein, 249 aa, Artificial Sequence
  VH-VL of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 24 - DNA, 747 bp, Artificial Sequence
  VH-VL of F6A
gaggtgcagctggtcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 25 - protein, 249 aa, Artificial Sequence
  VH-VL-P of F6A
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 26 - DNA, 747 bp, Artificial Sequence
  VH-VL-P of F6A
gaggtgcagctgctcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 27 - protein, 14 aa, Artificial Sequence
  CDR-L1 of H2C
GSSTGAVTSGYYPN

SEQ ID NO: 28 - protein, 7 aa, Artificial Sequence
  CDR-L2 of H2C
GTKFLAP

SEQ ID NO: 29 - protein, 9 aa, Artificial Sequence
  CDR-L3 of H2C
ALWYSNRWV

SEQ ID NO: 30 - protein, 5 aa, Artificial Sequence
  CDR-H1 of H2C
KYAMN

SEQ ID NO: 31 - protein, 19 aa, Artificial Sequence
  CDR-H2 of H2C
RIRSKYNNYATYYADSVKD

SEQ ID NO: 32 - protein, 14 aa, Artificial Sequence
  CDR-H3 of H2C
HGNFGNSYISYWAY

SEQ ID NO: 33 - protein, 125 aa, Artificial Sequence
  VH of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 34 - DNA, 375 bp, Artificial Sequence
  VH of H2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctca

SEQ ID NO: 35 - protein, 109 aa, Artificial Sequence; identical to SEQ ID NO: 17
  VL of H2C

SEQ ID NO: 36 - DNA, 327 bp, Artificial Sequence; identical to SEQ ID NO: 18
  VL of H2C

SEQ ID NO: 37 - protein, 125 aa, Artificial Sequence
  VH-P of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 38 - DNA, 375 bp, Artificial Sequence
  VH-P of H2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctca

SEQ ID NO: 39 - protein, 109 aa, Artificial Sequence; identical to SEQ ID NO: 21
  VL-P of H2C

SEQ ID NO: 40 - DNA, 327 bp, Artificial Sequence; identical to SEQ ID NO: 22
  VL-P of H2C

SEQ ID NO: 41 - protein, 249 aa, Artificial Sequence
  VH-VL of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 42 - DNA, 747 bp, Artificial Sequence
  VH-VL of H2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 43 - protein, 249 aa, Artificial Sequence
  VH-VL-P of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 44 - DNA, 747 bp, Artificial Sequence
  VH-VL-P of H2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 45 - protein, 14 aa, Artificial Sequence
  CDR-L1 of H1E
GSSTGAVTSGYYPN

SEQ ID NO: 46 - protein, 7 aa, Artificial Sequence
  CDR-L2 of H1E
GTKFLAP

SEQ ID NO: 47 - protein, 9 aa, Artificial Sequence
  CDR-L3 of H1E
ALWYSNRWV

SEQ ID NO: 48 - protein, 5 aa, Artificial Sequence
  CDR-H1 of H1E
SYAMN

SEQ ID NO: 49 - protein, 19 aa, Artificial Sequence
  CDR-H2 of H1E
RIRSKYNNYATYYADSVKG

SEQ ID NO: 50 - protein, 14 aa, Artificial Sequence
  CDR-H3 of H1E
HGNFGNSYLSFWAY

SEQ ID NO: 51 - protein, 125 aa, Artificial Sequence
  VH of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 52 - DNA, 374 bp, Artificial Sequence
  VH of H1E
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctc

SEQ ID NO: 53 - protein, 109 aa, Artificial Sequence; identical to SEQ ID NO: 17
  VL of H1E

SEQ ID NO: 54 - DNA, 327 bp, Artificial Sequence; identical to SEQ ID NO: 18
  VL of H1E

SEQ ID NO: 55 - protein, 125 aa, Artificial Sequence
  VH-P of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 56 - DNA, 375 bp, Artificial Sequence
  VH-P of H1E
gaggtgcagctgctcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctca

SEQ ID NO: 57 - protein, 109 aa, Artificial Sequence; identical to SEQ ID NO: 21
  VL-P of H1E

SEQ ID NO: 58 - DNA, 327 bp, Artificial Sequence; identical to SEQ ID NO: 22
  VL-P of H1E

SEQ ID NO: 59 - protein, 249 aa, Artificial Sequence
  VH-VL of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 60 - DNA, 747 bp, Artificial Sequence
  VH-VL of H1E
gaggtgcagctggtcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 61 - protein, 249 aa, Artificial Sequence
  VH-VL-P of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 62 - DNA, 747 bp, Artificial Sequence
  VH-VL-P of H1E
gaggtgcagctgctcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 63 - protein, 14 aa, Artificial Sequence
  CDR-L1 of G4H
GSSTGAVTSGYYPN

SEQ ID NO: 64 - protein, 7 aa, Artificial Sequence
  CDR-L2 of G4H
GTKFLAP

SEQ ID NO: 65 - protein, 9 aa, Artificial Sequence
  CDR-L3 of G4H
ALWYSNRWV

SEQ ID NO: 66 - protein, 5 aa, Artificial Sequence
  CDR-H1 of G4H
RYAMN

SEQ ID NO: 67 - protein, 19 aa, Artificial Sequence
  CDR-H2 of G4H
RIRSKYNNYATYYADSVKG

SEQ ID NO: 68 - protein, 14 aa, Artificial Sequence
  CDR-H3 of G4H
HGNFGNSYLSYFAY

SEQ ID NO: 69 - protein, 125 aa, Artificial Sequence
  VH of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 70 - DNA, 375 bp, Artificial Sequence
  VH of G4H
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctca

SEQ ID NO: 71 - protein, 109 aa, Artificial Sequence; identical to SEQ ID NO: 17
  VL of G4H

SEQ ID NO: 72 - DNA, 327 bp, Artificial Sequence; identical to SEQ ID NO: 18
  VL of G4H

SEQ ID NO: 73 - protein, 125 aa, Artificial Sequence
  VH-P of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 74 - DNA, 375 bp, Artificial Sequence
  VH-P of G4H
gaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctca

SEQ ID NO: 75 - protein, 109 aa, Artificial Sequence; identical to SEQ ID NO: 21
  VL-P of G4H

SEQ ID NO: 76 - DNA, 327 bp, Artificial Sequence; identical to SEQ ID NO: 22
  VL-P of G4H

SEQ ID NO: 77 - protein, 249 aa, Artificial Sequence
  VH-VL of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 78 - DNA, 747 bp, Artificial Sequence
  VH-VL of G4H
gaggtgcagctggtcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 79 - protein, 249 aa, Artificial Sequence
  VH-VL-P of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 80 - DNA, 747 bp, Artificial Sequence
  VH-VL-P of G4H
gaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 81 - protein, 14 aa, Artificial Sequence
  CDR-L1 of A2J
RSSTGAVTSGYYPN

SEQ ID NO: 82 - protein, 7 aa, Artificial Sequence
  CDR-L2 of A2J
ATDMRPS

SEQ ID NO: 83 - protein, 9 aa, Artificial Sequence
  CDR-L3 of A2J
ALWYSNRWV

SEQ ID NO: 84 - protein, 5 aa, Artificial Sequence
  CDR-H1 of A2J
VYAMN

SEQ ID NO: 85 - protein, 19 aa, Artificial Sequence
  CDR-H2 of A2J
RIRSKYNNYATYYADSVKK

SEQ ID NO: 86 - protein, 14 aa, Artificial Sequence
  CDR-H3 of A2J
HGNFGNSYLSWWAY

SEQ ID NO: 87 - protein, 125 aa, Artificial Sequence
  VH of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 88 - DNA, 375 bp, Artificial Sequence
  VH of A2J
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctca

SEQ ID NO: 89 - protein, 109 aa, Artificial Sequence
  VL of A2J
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 90 - DNA, 327 bp, Artificial Sequence
  VL of A2J
cagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 91 - protein, 125 aa, Artificial Sequence
  VH-P of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 92 - DNA, 375 bp, Artificial Sequence
  VH-P of A2J
gaggtgcagctgctcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctca

SEQ ID NO: 93 - protein, 109 aa, Artificial Sequence
  Artificial Sequence
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 94 - DNA, 327 bp, Artificial Sequence
  VL-P of A2J
gagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 95 - protein, 249 aa, Artificial Sequence
  VH-VL of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 96 - DNA, 747 bp, Artificial Sequence
  VH-VL of A2J
gaggtgcagctggtcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 97 - protein, 249 aa, Artificial Sequence
  VH-VL-P of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 98 - DNA, 747 bp, Artificial Sequence
  VH-VL-P of A2J
gaggtgcagctgctcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 99 - protein, 14 aa, Artificial Sequence
  CDR-L1 of E1L
GSSTGAVTSGYYPN

SEQ ID NO: 100 - protein, 7 aa, Artificial Sequence
  CDR-L2 of E1L
GTKFLAP

SEQ ID NO: 101 - protein, 9 aa, Artificial Sequence
  CDR-L3 of E1L
ALWYSNRWV

SEQ ID NO: 102 - protein, 5 aa, Artificial Sequence
  CDR-H1 of E1L
KYAMN

SEQ ID NO: 103 - protein, 19 aa, Artificial Sequence
  CDR-H2 of E1L
RIRSKYNNYATYYADSVKS

SEQ ID NO: 104 - protein, 14 aa, Artificial Sequence
  CDR-H3 of E1L
HGNFGNSYTSYYAY

SEQ ID NO: 105 - protein, 125 aa, Artificial Sequence
  VH of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 106 - DNA, 375 bp, Artificial Sequence
  VH of E1L
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctca

SEQ ID NO: 107 - protein, 109 aa, Artificial Sequence; identical to SEQ ID NO: 17
  VL of E1L

SEQ ID NO: 108 - DNA, 327 bp, Artificial Sequence; identical to SEQ ID NO: 18
  VL of E1L

SEQ ID NO: 109 - protein, 125 aa, Artificial Sequence
  VH-P of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 110 - DNA, 375 bp, Artificial Sequence
  VH-P of E1L
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctca

SEQ ID NO: 111 - protein, 109 aa, Artificial Sequence; identical to SEQ ID NO: 21
  VL-P of E1L

SEQ ID NO: 112 - DNA, 327 bp, Artificial Sequence; identical to SEQ ID NO: 22
  VL-P of E1L

SEQ ID NO: 113 - protein, 249 aa, Artificial Sequence
  VH-VL of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 114 - DNA, 747 bp, Artificial Sequence
  VH-VL of E1L
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 115 - protein, 249 aa, Artificial Sequence
  VH-VL-P of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 116 - DNA, 747 bp, Artificial Sequence
  VH-VL-P of E1L
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 117 - protein, 14 aa, Artificial Sequence
  CDR-L1 of E2M
RSSTGAVTSGYYPN

SEQ ID NO: 118 - protein, 7 aa, Artificial Sequence
  CDR-L2 of E2M
ATDMRPS

SEQ ID NO: 119 - protein, 9 aa, Artificial Sequence
  CDR-L3 of E2M
ALWYSNRWV

SEQ ID NO: 120 - protein, 5 aa, Artificial Sequence
  CDR-H1 of E2M
GYAMN

SEQ ID NO: 121 - protein, 19 aa, Artificial Sequence
  CDR-H2 of E2M
RIRSKYNNYATYYADSVKE

SEQ ID NO: 122 - protein, 14 aa, Artificial Sequence
  CDR-H3 of E2M
HRNFGNSYLSWFAY

SEQ ID NO: 123 - protein, 125 aa, Artificial Sequence
  VH of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 124 - DNA, 375 bp, Artificial Sequence
  VH of E2M
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctca

SEQ ID NO: 125 - protein, 109 aa, Artificial Sequence; identical to SEQ ID NO: 89
  VL of E2M

SEQ ID NO: 126 - DNA, 327 bp, Artificial Sequence; identical to SEQ ID NO: 90
  VL of E2M

SEQ ID NO: 127 - protein, 125 aa, Artificial Sequence
  VH-P of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 128 - DNA, 375 bp, Artificial Sequence
  VH-P of E2M
gaggtgcagctgctcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctca

SEQ ID NO: 129 - protein, 109 aa, Artificial Sequence; identical to SEQ ID NO: 93
  VL-P of E2M

SEQ ID NO: 130 - DNA, 327 bp, Artificial Sequence; identical to SEQ ID NO: 94
  VL-P of E2M

SEQ ID NO: 131 - protein, 249 aa, Artificial Sequence
  VH-VL of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 132 - DNA, 747 bp, Artificial Sequence
  VH-VL of E2M
gaggtgcagctggtcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 133 - protein, 249 aa, Artificial Sequence
  VH-VL-P of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 134 - DNA, 747 bp, Artificial Sequence
  VH-VL-P of E2M
gaggtgcagctgctcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 135 - protein, 14 aa, Artificial Sequence
  CDR-L1 of F7O
GSSTGAVTSGYYPN

SEQ ID NO: 136 - protein, 7 aa, Artificial Sequence
  CDR-L2 of F7O
GTKFLAP

SEQ ID NO: 137 - protein, 9 aa, Artificial Sequence
  CDR-L3 of F7O
ALWYSNRWV

SEQ ID NO: 138 - protein, 5 aa, Artificial Sequence
  CDR-H1 of F7O
VYAMN

SEQ ID NO: 139 - protein, 19 aa, Artificial Sequence
  CDR-H2 of F7O
RIRSKYNNYATYYADSVKK

SEQ ID NO: 140 - protein, 14 aa, Artificial Sequence
  CDR-H3 of F7O
HGNFGNSYISWWAY

SEQ ID NO: 141 - protein, 125 aa, Artificial Sequence
  VH of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 142 - DNA, 375 bp, Artificial Sequence
  VH of F7O
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctca

SEQ ID NO: 143 - protein, 109 aa, Artificial Sequence; identical to SEQ ID NO: 17
  VL of F7O

SEQ ID NO: 144 - DNA, 327 bp, Artificial Sequence; identical to SEQ ID NO: 18
  VL of F7O

SEQ ID NO: 145 - protein, 125 aa, Artificial Sequence
  VH-P of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 146 - DNA, 375 bp, Artificial Sequence
  VH-P of F7O
gaggtgcagctgctcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctca

SEQ ID NO: 147 - protein, 109 aa, Artificial Sequence; identical to SEQ ID NO: 21
  VL-P of F7O

SEQ ID NO: 148 - DNA, 327 bp, Artificial Sequence; identical to SEQ ID NO: 22
  VL-P of F7O

SEQ ID NO: 149 - protein, 249 aa, Artificial Sequence
  VH-VL of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 150 - DNA, 747 bp, Artificial Sequence
  VH-VL of F7O
gaggtgcagctggtcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 151 - protein, 249 aa, Artificial Sequence
  VH-VL-P of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 152 - DNA, 747 bp, Artificial Sequence
  VH-VL-P of F7O
gaggtgcagctgctcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 153 - protein, 14 aa, Artificial Sequence
  CDR-L1 of F12Q
GSSTGAVTSGNYPN

SEQ ID NO: 154 - protein, 7 aa, Artificial Sequence
  CDR-L2 of F12Q
GTKFLAP

SEQ ID NO: 155 - protein, 9 aa, Artificial Sequence
  CDR-L3 of F12Q
VLWYSNRWV

SEQ ID NO: 156 - protein, 5 aa, Artificial Sequence
  CDR-H1 of F12Q
SYAMN

SEQ ID NO: 157 - protein, 19 aa, Artificial Sequence
  CDR-H2 of F12Q
RIRSKYNNYATYYADSVKG

SEQ ID NO: 158 - protein, 14 aa, Artificial Sequence
  CDR-H3 of F12Q
HGNFGNSYVSWWAY

SEQ ID NO: 159 - protein, 125 aa, Artificial Sequence
  VH of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 160 - DNA, 375 bp, Artificial Sequence
  VH of F12Q
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctca

SEQ ID NO: 161 - protein, 109 aa, Artificial Sequence
  VL of F12Q
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 162 - DNA, 327 bp, Artificial Sequence
  VL of F12Q
cagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 163 - protein, 125 aa, Artificial Sequence
  VH-P of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 164 - DNA, 375 bp, Artificial Sequence
  VH-P of F12Q
gaggtgcagctgctcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctca

SEQ ID NO: 165 - protein, 109 aa, Artificial Sequence
  VL-P of F12Q
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 166 - DNA, 327 bp, Artificial Sequence
  VL-P of F12Q
gagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 167 - protein, 249 aa, Artificial Sequence
  VH-VL of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 168 - DNA, 747 bp, Artificial Sequence
  VH-VL of F12Q
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 169 - protein, 249 aa, Artificial Sequence
  VH-VL-P of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 170 - DNA, 747 bp, Artificial Sequence
  VH-VL-P of F12Q
gaggtgcagctgctcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 171 - protein, 14 aa, Artificial Sequence
  CDR-L1 of I2C
GSSTGAVTSGNYPN

SEQ ID NO: 172 - protein, 7 aa, Artificial Sequence
  CDR-L2 of I2C
GTKFLAP

SEQ ID NO: 173 - protein, 9 aa, Artificial Sequence
  CDR-L3 of I2C
VLWYSNRWV

SEQ ID NO: 174 - protein, 5 aa, Artificial Sequence
  CDR-H1 of I2C
KYAMN

SEQ ID NO: 175 - protein, 19 aa, Artificial Sequence
  CDR-H2 of I2C
RIRSKYNNYATYYADSVKD

SEQ ID NO: 176 - protein, 14 aa, Artificial Sequence
  CDR-H3 of I2C
HGNFGNSYISYWAY

SEQ ID NO: 177 - protein, 125 aa, Artificial Sequence; identical to SEQ ID NO: 33
  VH of I2C

SEQ ID NO: 178 - DNA, 375 bp, Artificial Sequence; identical to SEQ ID NO: 34
  VH of I2C

SEQ ID NO: 179 - protein, 109 aa, Artificial Sequence; identical to SEQ ID NO: 161
  VL of I2C

SEQ ID NO: 180 - DNA, 327 bp, Artificial Sequence; identical to SEQ ID NO: 162
  VL of I2C

SEQ ID NO: 181 - protein, 125 aa, Artificial Sequence; identical to SEQ ID NO: 37
  VH-P of I2C

SEQ ID NO: 182 - DNA, 375 bp, Artificial Sequence; identical to SEQ ID NO: 38
  VH-P of I2C

SEQ ID NO: 183 - protein, 109 aa, Artificial Sequence; identical to SEQ ID NO: 165
  VL-P of I2C

SEQ ID NO: 184 - DNA, 327 bp, Artificial Sequence; identical to SEQ ID NO: 166
  VL-P of I2C

SEQ ID NO: 185 - protein, 249 aa, Artificial Sequence
  VH-VL of I2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 186 - DNA, 747 bp, Artificial Sequence
  VH-VL of I2C
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 187 - protein, 249 aa, Artificial Sequence
  VH-VL-P of I2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 188 - DNA, 747 bp, Artificial Sequence
  VH-VL-P of I2C
gaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 189 - protein, 500 aa, Artificial Sequence
  MCSP-G4 VH-VL x H2C VH-VL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 190 - DNA, 1500 bp, Artificial Sequence
  MCSP-G4 VH-VL x H2C VH-VL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgatatcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 191 - protein, 500 aa, Artificial Sequence
  MCSP-G4 VH-VL x F12Q VH-VL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 192 - DNA, 1500 bp, Artificial Sequence
  MCSP-G4 VH-VL x F12Q VH-VL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgatatcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 193 - protein, 500 aa, Artificial Sequence
  MCSP-G4 VH-VL-P x F6A VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 194 - DNA, 1500 bp, Artificial Sequence
  MCSP-G4 VH-VL-P x F6A VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgatatcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 195 - protein, 500 aa, Artificial Sequence
  MCSP-G4 VH-VL-P x F6A VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 196 - DNA, 1500 bp, Artificial Sequence
  MCSP-G4 VH-VL-P x F6A VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaatatctacgccatgaactgggtccgccaggctccaggaaagggtttggaatgggttgctcgcataagaagtaaatataataattatgcaacatattatgccgattcagtgaaaagcaggttcaccatctccagagatgattcaaaaaacactgcctatctacaaatgaacaacttgaaaactgaggacactgccgtgtactactgtgtgagacatgggaacttcggtaatagctacgtatccttcttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 197 - protein, 500 aa, Artificial Sequence
  MCSP-G4 VH-VL-P x H2C VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 198 - DNA, 1500 bp, Artificial Sequence
  MCSP-G4 VH-VL-P x H2C VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 199 - protein, 500 aa, Artificial Sequence
  MCSP-G4 VH-VL-P x H1E VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 200 - DNA, 1500 bp, Artificial Sequence
  MCSP-G4 VH-VL-P x H1E VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggagcagcctggagggtcattgaaactctcatgtgcagcctctggattcaccttcaattcgtacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacctatccttctgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 201 - protein, 500 aa, Artificial Sequence
  MCSP-G4 VH-VL-P x G4H VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 202 - DNA, 1500 bp, Artificial Sequence
  MCSP-G4 VH-VL-P x G4H VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 203 - protein, 500 aa, Artificial Sequence
  MCSP-G4 VH-VL-P x A2J VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 204 - DNA, 1500 bp, Artificial Sequence
  MCSP-G4 VH-VL-P x A2J VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaatgtctacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacttatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 205 - protein, 500 aa, Artificial Sequence
  MCSP-G4 VH-VL-P x E1L VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 206 - DNA, 1500 bp, Artificial Sequence
  MCSP-G4 VH-VL-P x E1L VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaatcgaggttcaccatctccagagatgattcaaaaaacactgcctatctacaaatgaacaacttgaaaactgaggacactgccgtgtactactgtgtgagacatgggaacttcggtaatagctacacatcctactacgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 207 - protein, 500 aa, Artificial Sequence
  MCSP-G4 VH-VL-P x E2M VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 208 - DNA, 1500 bp, Artificial Sequence
  MCSP-G4 VH-VL-P x E2M VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaatggctacgccatgaactgggtccgccaggctccaggaaagggtttggaatgggttgctcgcataagaagtaaatataataattatgcaacatattatgccgattcagtgaaagagaggttcaccatctccagagatgattcaaaaaacactgcctatctacaaatgaacaacttgaaaactgaggacactgccgtgtactactgtgtgagacataggaacttcggtaatagctacttatcctggttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtcgctcctcgactggggctgttacatctggctactacccaaactgggtccaacaaaaaccaggtcaggcaccccgtggtctaataggtgccactgacatgaggccctctggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 209 - protein, 500 aa, Artificial Sequence
  MCSP-G4 VH-VL-P x F7O VH-VL-P
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 210 - DNA, 1500 bp, Artificial Sequence
  MCSP-G4 VH-VL-P x F7O VH-VL-P
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaatgtgtacgccatgaactgggtccgccaggctccaggaaagggtttggaatgggttgctcgcataagaagtaaatataataattatgcaacatattatgccgattcagtgaaaaagaggttcaccatctccagagatgattcaaaaaacactgcctatctacaaatgaacaacttgaaaactgaggacactgccgtgtactactgtgtgagacatgggaacttcggtaatagctacatatcctggtgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 211 - protein, 500 aa, Artificial Sequence
  MCSP-G4 VH-VL-P x F12Q VH-VL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 212 - DNA, 1500 bp, Artificial Sequence
  MCSP-G4 VH-VL-P x F12Q VH-VL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 213 - protein, 500 aa, Artificial Sequence
  MCSP-G4 VH-VL-P x I2C VH-VL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 214 - DNA, 1500 bp, Artificial Sequence
  MCSP-G4 VH-VL-P x I2C VH-VL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 215 - protein, 500 aa, Artificial Sequence
  MCSP-D2 VH-VL x H2C VH-VL
QVQLVQSGAEVKKPGASVKVSCKASGYTFTGYYMHWVRQAPGQGLEWMGWINPNSGGTSYAQKFQGRVTMTRDTSTSTVYMELSNLRSDDTAVYYCAKSWVSWFASWGQGTLVTVSSGGGGSGGGGSGGGGSDIVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 216 - DNA, 1500 bp, Artificial Sequence
  MCSP-D2 VH-VL x H2C VH-VL
caggtgcagctggtccagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaagctacgcacagaagttccagggcagagtcaccatgactagggacacgtccacgagcacagtctacatggagctgagcaacctgagatctgacgacacggccgtgtattactgtgcgaaatcctgggtctcctggtttgcttcctggggtcaaggaaccttggtcaccgtctcctcaggtggtggtggttctggcggcggcggctccggtggtggtggttctgatatcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 217 - protein, 500 aa, Artificial Sequence
  MCSP-D2 VH-VL x F12Q VH-VL
QVQLVQSGAEVKKPGASVKVSCKASGYTFTGYYMHWVRQAPGQGLEWMGWINPNSGGTSYAQKFQGRVTMTRDTSTSTVYMELSNLRSDDTAVYYCAKSWVSWFASWGQGTLVTVSSGGGGSGGGGSGGGGSDIVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 218 - DNA, 1500 bp, Artificial Sequence
  MCSP-D2 VH-VL x F12Q VH-VL
caggtgcagctggtccagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaagctacgcacagaagttccagggcagagtcaccatgactagggacacgtccacgagcacagtctacatggagctgagcaacctgagatctgacgacacggccgtgtattactgtgcgaaatcctgggtctcctggtttgcttcctggggtcaaggaaccttggtcaccgtctcctcaggtggtggtggttctggcggcggcggctccggtggtggtggttctgatatcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 219 - protein, 500 aa, Artificial Sequence
  MCSP-D2 VH-VL x I2C VH-VL
QVQLVQSGAEVKKPGASVKVSCKASGYTFTGYYMHWVRQAPGQGLEWMGWINPNSGGTSYAQKFQGRVTMTRDTSTSTVYMELSNLRSDDTAVYYCAKSWVSWFASWGQGTLVTVSSGGGGSGGGGSGGGGSDIVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 220 - DNA, 1500 bp, Artificial Sequence
  MCSP-D2 VH-VL x I2C VH-VL
caggtgcagctggtccagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaagctacgcacagaagttccagggcagagtcaccatgactagggacacgtccacgagcacagtctacatggagctgagcaacctgagatctgacgacacggccgtgtattactgtgcgaaatcctgggtctcctggtttgcttcctggggtcaaggaaccttggtcaccgtctcctcaggtggtggtggttctggcggcggcggctccggtggtggtggttctgatatcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 221 - protein, 500 aa, Artificial Sequence
  MCSP-D2 VH-VL-P x H2C VH-VL-P
QVQLVQSGAEVKKPGASVKVSCKASGYTFTGYYMHWVRQAPGQGLEWMGWINPNSGGTSYAQKFQGRVTMTRDTSTSTVYMELSNLRSDDTAVYYCAKSWVSWFASWGQGTLVTVSSGGGGSGGGGSGGGGSELVMTQSPDSLAVSLGERATINCKSSQSVLNSSNNRNYLAWYQQKPGQPPKLLIYWASTRESGVPDRFSGSGSGTDFTLTISGLQAEDVAVYYCQQHYSTPFTFGPGTKVDIKSGGGGSEVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 222 - DNA, 1500 bp, Artificial Sequence
  MCSP-D2 VH-VL-P x H2C VH-VL-P
caggtgcagctggtccagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaagctacgcacagaagttccagggcagagtcaccatgactagggacacgtccacgagcacagtctacatggagctgagcaacctgagatctgacgacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacccagtctccagactccctggctgtgtctctgggcgagagggccaccatcaactgcaagtccagccagagtgttttaaacagctccaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 223 - protein, 499 aa, Artificial Sequence
  MCSP-F9 VH-VL x H2C VH-VL
QVQLQESGPGLVKPSETLSLTCVVSGGSISSSNWWSWVRQPPGKGLEWLGTIYYNGNTYYNPSLKSRVTISVDTSKNQFSLRLSSVTAADTAVYYCAKSWVSWFASWGQGTLVTVSSGGGGSGGGGSGGGGSDIVMTQSPDSLAVSLGERATINCKSSQSVLSSSNNKNYLNWYQQKPGQPPKLLIYWASTRESGVPDRFSGSGSGTDFTLTISSLQAEDVAVYYCQQHYSVPFTFGPGTKVDIKGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 224 - DNA, 1497 bp, Artificial Sequence
  MCSP-F9 VH-VL x H2C VH-VL
caggtgcagctgcaagagtctggcccaggactggtgaagccttcggagaccctgtccctcacctgcgttgtctctggtggctccatcagcagtagtaactggtggagctgggtccgccagcccccagggaagggactggagtggcttgggactatctattataatgggaatacctactacaacccgtccctcaagagtcgagtcaccatctccgtagacacgtccaagaaccagttctccctgaggctgagctctgtgaccgccgcagacacggccgtgtattactgtgcgaaatcctgggtctcctggtttgcttcctggggtcaaggaaccttggtcaccgtctcctcaggtggtggtggttctggcggcggcggctccggtggtggtggttctgatatcgtgatgacacagtctccagactccctggctgtgtctctgggcgagagggccaccatcaactgcaagtccagccagagtgtcttatccagctccaacaataagaactacttaaattggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaacattatagtgttccattcactttcggccctgggaccaaagtggatatcaaaggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 225 - protein, 500 aa, Artificial Sequence
  MCSP-F9 VH-VL-P x H2C VH-VL-P
EVQLQESGPGLVKPSETLSLTCVVSGGSISSSNWWSWVRQPPGKGLEWLGTIYYNGNTYYNPSLKSRVTISVDTSKNQFSLRLSSVTAADTAVYYCAKSWVSWFASWGQGTLVTVSSGGGGSGGGGSGGGGSELVMTQSPDSLAVSLGERATINCKSSQSVLSSSNNKNYLNWYQQKPGQPPKLLIYWASTRESGVPDRFSGSGSGTDFTLTISSLQAEDVAVYYCQQHYSVPFTFGPGTKVDIKSGGGGSEVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 226 - DNA, 1500 bp, Artificial Sequence
  MCSP-F9 VH-VL-P x H2C VH-VL-P
gaggtgcagctgcaagagtctggcccaggactggtgaagccttcggagaccctgtccctcacctgcgttgtctctggtggctccatcagcagtagtaactggtggagctgggtccgccagcccccagggaagggactggagtggcttgggactatctattataatgggaatacctactacaacccgtccctcaagagtcgagtcaccatctccgtagacacgtccaagaaccagttctccctgaggctgagctctgtgaccgccgcagacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacacagtctccagactccctggctgtgtctctgggcgagagggccaccatcaactgcaagtccagccagagtgtcttatccagctccaacaataagaactacttaaattggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaacattatagtgttccattcactttcggccctgggaccaaagtggatatcaaatccggaggtggtggatccgaggtgcagctgctcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 227 - protein, 500 aa, Artificial Sequence
  MCSP-F9 VH-VL-P x G4H VH-VL-P
EVQLQESGPGLVKPSETLSLTCVVSGGSISSSNWWSWVRQPPGKGLEWLGTIYYNGNTYYNPSLKSRVTISVDTSKNQFSLRLSSVTAADTAVYYCAKSWVSWFASWGQGTLVTVSSGGGGSGGGGSGGGGSELVMTQSPDSLAVSLGERATINCKSSQSVLSSSNNKNYLNWYQQKPGQPPKLLIYWASTRESGVPDRFSGSGSGTDFTLTISSLQAEDVAVYYCQQHYSVPFTFGPGTKVDIKSGGGGSEVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 228 - DNA, 1500 bp, Artificial Sequence
  MCSP-F9 VH-VL-P x G4H VH-VL-P
gaggtgcagctgcaagagtctggcccaggactggtgaagccttcggagaccctgtccctcacctgcgttgtctctggtggctccatcagcagtagtaactggtggagctgggtccgccagcccccagggaagggactggagtggcttgggactatctattataatgggaatacctactacaacccgtccctcaagagtcgagtcaccatctccgtagacacgtccaagaaccagttctccctgaggctgagctctgtgaccgccgcagacacggccgtgtattactgtgcgaaatcctgggtctcctggtttgcttcctggggtcaaggaaccttggtcaccgtctcctcaggtggtggtggttctggcggcggcggctccggtggtggtggttctgagctcgtgatgacacagtctccagactccctggctgtgtctctgggcgagagggccaccatcaactgcaagtccagccagagtgtcttatccagctccaacaataagaactacttaaattggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaacattatagtgttccattcactttcggccctgggaccaaagtggatatcaaatccggaggtggtggatccgaggtgcagctgctcgagtctggaggaggattggtgcagcctggagggtcattgaaactctcatgtgcagcctctggattcaccttcaatcgctacgccatgaactgggtccgccaggctccaggaaagggtttggaatgggttgctcgcataagaagtaaatataataattatgcaacatattatgccgattcagtgaaagggaggttcaccatctccagagatgattcaaaaaacactgcctatctacaaatgaacaacttgaaaactgaggacactgccgtgtactactgtgtgagacatgggaacttcggtaatagctacttatcctacttcgcttactggggccaagggactctggtcaccgtctcctcaggtggtggtggttctggcggcggcggctccggtggtggtggttctgagctcgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 229 - protein, 267 aa, Artificial Sequence
  1-27 CD3 epsilon-Fc
QDGNEEMGGITQTPYKVSISGTTVILTSGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKHHHHHH

SEQ ID NO: 230 - DNA, 858 bp, Artificial Sequence
  1-27 CD3 epsilon-Fc
atgggatggagctgtatcatcctcttcttggtagcaacagctacaggtgtacactcccaagatggtaatgaagaaatgggtggtattacacagacaccatataaagtctccatctctggaaccacagtaatattgacatccggagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaacatcatcaccatcatcat

SEQ ID NO: 231 - protein, 333 aa, Artificial Sequence
  human 1-27 CD3 epsilon-EpCAM
QDGNEEMGGITQTPYKVSISGTTVILTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNA

SEQ ID NO: 232 - DNA, 1056 bp, Artificial Sequence
  human 1-27 CD3 epsilon-EpCAM
atgggatggagctgtatcatcctcttcttggtagcaacagctacaggtgtacactcccaagatggtaatgaagaaatgggtggtattacacagacaccatataaagtctccatctctggaaccacagtaatattgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 233 - protein, 333 aa, Artificial Sequence
  marmoset 1-27 CD3 epsilon-EpCAM
QDGNEEMGDTTQNPYKVSISGTTVTLTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNA

SEQ ID NO: 234 - DNA, 1056 bp, Artificial Sequence
  marmoset 1-27 CD3 epsilon-EpCAM
atgggatggagctgtatcatcctcttcttggtagcaacagctacaggtgtacactcccaggacggtaatgaagaaatgggtgatactacacagaacccatataaagtttccatctcaggaaccacagtaacactgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 235 - protein, 333 aa, Artificial Sequence; identical to SEQ ID NO: 233
  tamarin 1-27 CD3 epsilon-EpCAM

SEQ ID NO: 236 - DNA, 1056 bp, Artificial Sequence; identical to SEQ ID NO: 234
  tamarin 1-27 CD3 epsilon-EpCAM

SEQ ID NO: 237 - protein, 333 aa, Artificial Sequence
  squirrel monkey 1-27 CD3 epsilon-EpCAM
QDGNEEIGDTTQNPYKVSISGTTVTLTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNA

SEQ ID NO: 238 - DNA, 1056 bp, Artificial Sequence
  squirrel monkey 1-27 CD3 epsilon-EpCAM
atgggatggagctgtatcatcctcttcttggtagcaacagctacaggtgtacactcccaggacggtaatgaagagattggtgatactacccagaacccatataaagtttccatctcaggaaccacagtaacactgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 239 - protein, 333 aa, Artificial Sequence
  swine 1-27 CD3 epsilon-EpCAM
QEDIERPDEDTQKTFKVSISGDKVELTDYKDDDDKTASFAAAQKECVCENYKLAVNCFLNDNGQCQCTSIGAQNTVLCSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDVQSLRTALEEAIKTRYQLDPKFITNILYEDNVITIDLVQNSSQKTQNDVDIADVAYYFEKDVKGESLFHSKKMDLRVNGEQLDLDPGQTLIYYVDEKAPEFSMQGLKAGVIAVIVVVVIAIVAGIVVLVISRKKRMAKYEKAEIKEMGEMHRELNA

SEQ ID NO: 240 - DNA, 1056 bp, Artificial Sequence
  swine 1-27 CD3 epsilon-EpCAM
atgggatggagctgtatcatcctcttcttggtagcaacagctacaggtgtacactcccaagaagacattgaaagaccagatgaagatacacagaaaacatttaaagtctccatctctggagacaaagtagagctgacagattacaaggacgacgatgacaagactgcgagttttgccgcagctcagaaagaatgtgtctgtgaaaactacaagctggccgtaaactgctttttgaatgacaatggtcaatgccagtgtacttcgattggtgcacaaaatactgtcctttgctcaaagctggctgccaaatgtttggtgatgaaggcagaaatgaacggctcaaaacttgggagaagagcgaaacctgaaggggctctccagaacaatgatggcctttacgatcctgactgcgatgagagcgggctctttaaggccaagcagtgcaacggcacctccacgtgctggtgtgtgaacactgctggggtcagaagaactgacaaggacactgaaataacctgctctgagcgagtgagaacctactggatcatcattgaattaaaacacaaagcaagagaaaaaccttatgatgttcaaagtttgcggactgcacttgaggaggcgatcaaaacgcgttatcaactggatccaaaatttatcacaaatattttgtatgaggataatgttatcactattgatctggttcaaaattcttctcagaaaactcagaatgatgtggacatagctgatgtggcttattattttgaaaaagatgttaaaggtgaatccttgtttcattctaagaaaatggacctgagagtaaatggggaacaactggatctggatcctggtcaaactttaatttattatgtcgatgaaaaagcacctgaattctcaatgcagggtctaaaagctggtgttattgctgttattgtggttgtggtgatagcaattgttgctggaattgttgtgctggttatttccagaaagaagagaatggcaaagtatgagaaggctgagataaaggagatgggtgagatgcatagggaactcaatgca

SEQ ID NO: 241 - protein, 186 aa, Homo sapiens
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 242 - DNA, 621 bp, Homo sapiens
atgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcacgcgtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatc

SEQ ID NO: 243 - protein, 19 aa, Artificial Sequence
  19 amino acid immunoglobulin leader peptide
MGWSCIILFLVATATGVHS

SEQ ID NO: 244 - DNA, 57 bp, Artificial Sequence
  19 amino acid immunoglobulin leader peptide coding sequence
atgggatggagctgtatcatcctcttcttggtagcaacagctacaggtgtacactcc

SEQ ID NO: 245 - protein, 324 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 246 - DNA, 972 bp, Mus musculus
gccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 247 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 248 - DNA, 318 bp, Homo sapiens
ggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 249 - protein, 800 aa, Homo sapiens
DYKDDDDKSRTRSGSQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNSSSSHDHFRVLALARGVNASAVVNVTVRALLHVWAGGPWPQGATLRLDPTVLDAGELANRTDSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 250 - DNA, 2457 bp, Homo sapiens
atgggatggagctgtatcatcctcttcttggtagcaacagctacaggtgtacactccgactacaaagacgatgacgacaagtcccgtacgagatctggatcccaattggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccgcggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccggttgatccagggaccccagtatgggcatctcctggtgggcgggcggcccacctcggccttcagccaattccagatagaccagggcgaggtggtctttgccttcaccaactcctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacagacagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagctttctagaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtg

SEQ ID NO: 251 - protein, 807 aa, Macaca fascicularis
  misc_feature (714)..(714): Xaa can be any naturally occurring amino acid
PSNGRVVLRAAPGTEVRSFTQAQLDGGLVLFSHRGTLDGGFRFGLSDGEHTSSGHFFRVTAQKQVLLSLEGSRTLTVCPGSVQPLSSQTLRASSSAGTDPQLLLYRVVRGPQLGRLFHAQQDSTGEALVNFTQAEVYAGNILYEHEMPTEPFWEAHDTLELQLSSPPARDVAATLAVAVSFEAACPQRPSHLWKNKGLWVPEGQRAKITMAALDASNLLASVPSSQRLEHDVLFQVTQFPSRGQLLVSEEPLHAGQPHFLQSQLAAGQLVYAHGGGGTQQDGFHFRAHLQGPAGATVAGPQTSEAFAITVRDVNERPPQPQASVPLRITRGSRAPISRAQLSVVDPDSAPGEIEYEVQRAPHNGFLSLVGGGPGPVNRFTQADVDSGRLAFVANGSSVAGVFQLSMSDGASPPLPMSLAVDILPSAIEVQLQAPLEVPQALGRSSLSQQQLRVVSDREEPEAAYRLIQGPKYGHLLVGGQPASAFSQLQIDQGEVVFAFTNFSSSHDHFRVLALARGVNASAVVNITVRALLHVWAGGPWPQGATLRLDPTILDAGELANRTGSVPRFRLLEGPRHGRVVRVPRARMEPGGSQLVEQFTQQDLEDGRLGLEVGRPEGRAPSPTGDSLTLELWAQGVPPAVASLDFATEPYNAARPYSVALLSVPEATRTEAGKPESSTPTGEPGPMASSPVPAVAKGGFLGFLEANMFSVIIPXCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 252 - DNA, 2421 bp, Macaca fascicularis
cccagcaacggacgggtagtgctgcgggcggcgccgggcaccgaggtgcgcagcttcacgcaggcccagctggatggcggactcgtgctgttctcacacagaggaaccctggatggaggcttccgcttcggcctctccgatggcgagcacacttcctctggacacttcttccgagtgacggcccagaagcaagtgctcctctcgctggagggcagccggacactgactgtctgcccagggtccgtgcagccactcagcagtcagaccctcagagccagctccagcgcaggcaccgacccccagctcctgctctaccgtgtggtgcggggcccccagctaggccggctgttccatgcccagcaggacagcacaggggaggccctggtgaacttcactcaggcagaggtctatgctgggaatattctgtatgagcatgagatgcccaccgagcccttctgggaggcccatgataccctagagctccagctgtcctcaccacctgcccgggacgtggctgccacccttgctgtggctgtgtcttttgaggctgcctgtccccagcgccccagccacctctggaagaacaaaggtctctgggtccccgagggccagcgggccaagatcaccatggctgccctggatgcctccaacctcttggccagcgttccatcatcccagcgcctagagcatgatgtgctcttccaggtcacgcagttccccagccggggccagctattggtgtctgaggagcccctccacgctgggcagccccacttcctgcagtcccagctggctgcagggcagctagtgtatgcccacggcggtgggggtacccaacaggatggcttccactttcgtgcccacctccaggggccagcaggggccaccgtggctggaccccaaacctcagaggcttttgccatcacggtgcgggatgtaaatgagcggccccctcagccacaggcctctgtcccactccggatcacccgaggctctcgagcccccatctcccgggcccagctgagtgtcgtggacccagactcagctcctggggagattgagtatgaggtccagcgggcaccccacaacggcttcctcagcctggtgggtggtggcccggggcccgtgaaccgcttcacgcaagccgatgtggattcggggcggctggccttcgtggccaacgggagcagcgtagcaggcgtcttccagctgagcatgtctgatggggccagcccaccgctgcccatgtccctggccgtggacatcctaccatccgccatcgaggtgcagctgcaggcacccctggaggtgccccaagctttggggcgctcctcactgagccagcagcagctccgggtggtttcagatagggaggagccagaggcagcataccgcctcatccagggaccaaagtacgggcatctcctggtgggtgggcagcccgcctcggccttcagccaactccagatagaccagggcgaggtggtctttgccttcaccaacttctcctcctctcatgaccacttcagagtcctggcactggctaggggtgtcaacgcatcagccgtagtgaacatcactgtgagggctctgctgcacgtgtgggcaggtgggccatggccccagggtgctaccctgcgcctggacccaaccatcctagatgctggcgagctggccaaccgcacaggcagtgtgccccgcttccgcctcctggagggaccccggcatggccgcgtggtccgtgtgccccgagccaggatggagcctgggggcagccagctggtggagcagttcactcagcaggaccttgaggatgggaggctggggctggaggtgggcaggccagagggaagggcccccagccccacaggcgacagtctcactctggagctgtgggcacagggcgtcccacctgctgtggcctccctggactttgccactgagccttacaatgctgcccggccctacagcgtggccctgctcagtgtccccgaggccacccggacggaagcagggaagccagagagcagcacccccacaggcgagccaggccccatggcatctagccctgtgcctgctgtggccaagggaggcttcctgggcttccttgaggccaacatgttcagtgtcatcatccccrtgtgcctggtccttctgctcctggcgctcatcttgcccctgctcttctacctccgaaaacgcaacaagacgggcaagcatgacgtccaggtcctgactgccaagccccgcaatggtctggctggtgacactgagacctttcgcaaggtggagccaggccaggccatcccgctcacagctgtgcctggccaggggccccctccgggaggccagcctgacccagagctgctgcagttctgccggacacccaaccctgcccttaagaatggccagtactgggtg

SEQ ID NO: 253 - DNA, 18 bp, Artificial Sequence
  PCR primer for CD3 epsilon chain - forward primer
agagttctgggcctctgc

SEQ ID NO: 254 - DNA, 19 bp, Artificial Sequence
  PCR primer for CD3 epsilon chain - reverse primer
cggatgggctcatagtctg

SEQ ID NO: 255 - protein, 192 aa, Artificial Sequence
  His6-human CD3 epsilon
HHHHHHQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 256 - DNA, 633 bp, Artificial Sequence
  His6-human CD3 epsilon
atgggatggagctgtatcatcctcttcttggtagcaacagctacaggtgtacactcccatcatcaccatcatcatcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcacgcgtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatc

SEQ ID NO: 257 - protein, 505 aa, Artificial Sequence
  CD33 AH3 HL x H2C HL
QVQLVQSGAEVKKPGESVKVSCKASGYTFTNYGMNWVRQAPGQGLEWMGWINTYTGEPTYADDFKGRVTMSSDTSTSTAYLEINSLRSDDTAIYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 258 - DNA, 1515 bp, Artificial Sequence
  CD33 AH3 HL x H2C HL
caggtgcagctggtgcagtctggagctgaggtgaaaaagcctggagagtcagtcaaggtctcctgcaaggctagcgggtataccttcacaaactatggaatgaactgggtgaggcaggctccaggacagggtttagagtggatgggctggataaacacctacactggagagccaacatatgctgatgacttcaagggacgggttaccatgtcttcggatacctctaccagcactgcctatttggaaatcaacagcctcagaagtgatgacacggctatatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 259 - protein, 505 aa, Artificial Sequence
  CD33 AH3 HL x F12Q HL
QVQLVQSGAEVKKPGESVKVSCKASGYTFTNYGMNWVRQAPGQGLEWMGWINTYTGEPTYADDFKGRVTMSSDTSTSTAYLEINSLRSDDTAIYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 260 - DNA, 1515 bp, Artificial Sequence
  CD33 AH3 HL x F12Q HL
caggtgcagctggtgcagtctggagctgaggtgaaaaagcctggagagtcagtcaaggtctcctgcaaggctagcgggtataccttcacaaactatggaatgaactgggtgaggcaggctccaggacagggtttagagtggatgggctggataaacacctacactggagagccaacatatgctgatgacttcaagggacgggttaccatgtcttcggatacctctaccagcactgcctatttggaaatcaacagcctcagaagtgatgacacggctatatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 261 - protein, 505 aa, Artificial Sequence
  CD33 AH3 HL x I2C HL
QVQLVQSGAEVKKPGESVKVSCKASGYTFTNYGMNWVRQAPGQGLEWMGWINTYTGEPTYADDFKGRVTMSSDTSTSTAYLEINSLRSDDTAIYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 262 - DNA, 1515 bp, Artificial Sequence
  CD33 AH3 HL x I2C HL
caggtgcagctggtgcagtctggagctgaggtgaaaaagcctggagagtcagtcaaggtctcctgcaaggctagcgggtataccttcacaaactatggaatgaactgggtgaggcaggctccaggacagggtttagagtggatgggctggataaacacctacactggagagccaacatatgctgatgacttcaagggacgggttaccatgtcttcggatacctctaccagcactgcctatttggaaatcaacagcctcagaagtgatgacacggctatatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 263 - protein, 505 aa, Artificial Sequence
  CD33 AF5 HL x H2C HL
QVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 264 - DNA, 1515 bp, Artificial Sequence
  CD33 AF5 HL x H2C HL
caggtgcagctggtgcagtctggagctgaggtgaagaagcctggagcgtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatttggaactccacaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 265 - protein, 505 aa, Artificial Sequence
  CD33 AF5 HL x F12Q HL
QVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 266 - DNA, 1515 bp, Artificial Sequence
  CD33 AF5 HL x F12Q HL
caggtgcagctggtgcagtctggagctgaggtgaagaagcctggagcgtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatttggaactccacaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 267 - protein, 505 aa, Artificial Sequence
  CD33 AF5 HL x I2C HL
QVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 268 - DNA, 1515 bp, Artificial Sequence
  CD33 AF5 HL x I2C HL
caggtgcagctggtgcagtctggagctgaggtgaagaagcctggagcgtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatttggaactccacaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 269 - protein, 505 aa, Artificial Sequence
  CD33 AC8 HL x H2C HL
QVQLVQSGAEVKKPGESVKVSCKASGYTFTNYGMNWVKQAPGQGLKWMGWINTYTGEPTYADDFKGRVTMTTDTSTSTAYMEIRNLRNDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 270 - DNA, 1515 bp, Artificial Sequence
  CD33 AC8 HL x H2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgactacggatacctctaccagcactgcctatatggaaatccgcaacctcagaaatgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 271 - protein, 505 aa, Artificial Sequence
  CD33 AC8 HL x F12Q HL
QVQLVQSGAEVKKPGESVKVSCKASGYTFTNYGMNWVKQAPGQGLKWMGWINTYTGEPTYADDFKGRVTMTTDTSTSTAYMEIRNLRNDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 272 - DNA, 1515 bp, Artificial Sequence
  CD33 AC8 HL x F12Q HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgactacggatacctctaccagcactgcctatatggaaatccgcaacctcagaaatgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 273 - protein, 505 aa, Artificial Sequence
  CD33 AC8 HL x I2C HL
QVQLVQSGAEVKKPGESVKVSCKASGYTFTNYGMNWVKQAPGQGLKWMGWINTYTGEPTYADDFKGRVTMTTDTSTSTAYMEIRNLRNDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 274 - DNA, 1515 bp, Artificial Sequence
  CD33 AC8 HL x I2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgactacggatacctctaccagcactgcctatatggaaatccgcaacctcagaaatgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 275 - protein, 505 aa, Artificial Sequence
  CD33 AH11 HL x H2C HL
QVQLVQSGAEVKKPGESVKVSCKASGYTFTNYGMNWVKQAPGQGLKWMGWINTYTGEPTYADDFKGRVTMTSDTSTSTAYMEISSLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 276 - DNA, 1515 bp, Artificial Sequence
  CD33 AH11 HL x H2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatatggaaatcagcagcctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 277 - protein, 505 aa, Artificial Sequence
  CD33 AH11 HL x F12Q HL
QVQLVQSGAEVKKPGESVKVSCKASGYTFTNYGMNWVKQAPGQGLKWMGWINTYTGEPTYADDFKGRVTMTSDTSTSTAYMEISSLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 278 - DNA, 1515 bp, Artificial Sequence
  CD33 AH11 HL x F12Q HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatatggaaatcagcagcctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 279 - protein, 505 aa, Artificial Sequence
  CD33 AH11 HL x I2C HL
QVQLVQSGAEVKKPGESVKVSCKASGYTFTNYGMNWVKQAPGQGLKWMGWINTYTGEPTYADDFKGRVTMTSDTSTSTAYMEISSLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 280 - DNA, 1515 bp, Artificial Sequence
  CD33 AH11 HL x I2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatatggaaatcagcagcctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 281 - protein, 505 aa, Artificial Sequence
  CD33 B3 HL x H2C HL
QVQLVQSGAEVKKPGESVKVSCKASGYTFTNYGMNWVKQAPGQGLEWMGWINTYTGETNYADKFQGRVTFTSDTSTSTAYMELRNLKSDDTAVYYCARWSWSDGYYVYFDYWGQGTTVTVSSGGGGSGGGGSGGGGSDIVMTQSPDSMTVSLGERTTINCKSSQSVLDSSTNKNSLAWYQQKPGQPPKLLLSWASTRESGIPDRFSGSGSGTDFTLTIDSLQPEDSATYYCQQSAHFPITFGQGTRLDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 282 - DNA, 1515 bp, Artificial Sequence
  CD33 B3 HL x H2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagacaaactatgctgataagttccagggacgcgttaccttcacttcggatacctctaccagcactgcctatatggaactccgcaacctcaaaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccatgactgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggacattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 283 - protein, 505 aa, Artificial Sequence
  CD33 B3 HL x F12Q HL
QVQLVQSGAEVKKPGESVKVSCKASGYTFTNYGMNWVKQAPGQGLEWMGWINTYTGETNYADKFQGRVTFTSDTSTSTAYMELRNLKSDDTAVYYCARWSWSDGYYVYFDYWGQGTTVTVSSGGGGSGGGGSGGGGSDIVMTQSPDSMTVSLGERTTINCKSSQSVLDSSTNKNSLAWYQQKPGQPPKLLLSWASTRESGIPDRFSGSGSGTDFTLTIDSLQPEDSATYYCQQSAHFPITFGQGTRLDIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 284 - DNA, 1515 bp, Artificial Sequence
  CD33 B3 HL x F12Q HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagacaaactatgctgataagttccagggacgcgttaccttcacttcggatacctctaccagcactgcctatatggaactccgcaacctcaaaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccatgactgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggacattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 285 - protein, 505 aa, Artificial Sequence
  CD33 B3 HL x I2C HL
QVQLVQSGAEVKKPGESVKVSCKASGYTFTNYGMNWVKQAPGQGLEWMGWINTYTGETNYADKFQGRVTFTSDTSTSTAYMELRNLKSDDTAVYYCARWSWSDGYYVYFDYWGQGTTVTVSSGGGGSGGGGSGGGGSDIVMTQSPDSMTVSLGERTTINCKSSQSVLDSSTNKNSLAWYQQKPGQPPKLLLSWASTRESGIPDRFSGSGSGTDFTLTIDSLQPEDSATYYCQQSAHFPITFGQGTRLDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 286 - DNA, 1515 bp, Artificial Sequence
  CD33 B3 HL x I2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagacaaactatgctgataagttccagggacgcgttaccttcacttcggatacctctaccagcactgcctatatggaactccgcaacctcaaaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccatgactgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggacattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 287 - protein, 505 aa, Artificial Sequence
  CD33 F2 HL x H2C HL
QVQLVQSGAEVKKPGESVKVSCKASGYTFTNYGMNWVKQAPGQGLEWMGWINTYTGETNYADKFQGRVTFTSDTSTSTAYMELRNLKSDDTAVYYCARWSWSDGYYVYFDYWGQGTTVTVSSGGGGSGGGGSGGGGSDIVMTQSPDSLSVSLGERTTINCKSSQSVLDSSTNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 288 - DNA, 1515 bp, Artificial Sequence
  CD33 F2 HL x H2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagacaaactatgctgataagttccagggacgcgttaccttcacttcggatacctctaccagcactgcctatatggaactccgcaacctcaaaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgtctgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 289 - protein, 505 aa, Artificial Sequence
  CD33 F2 HL x F12Q HL
QVQLVQSGAEVKKPGESVKVSCKASGYTFTNYGMNWVKQAPGQGLEWMGWINTYTGETNYADKFQGRVTFTSDTSTSTAYMELRNLKSDDTAVYYCARWSWSDGYYVYFDYWGQGTTVTVSSGGGGSGGGGSGGGGSDIVMTQSPDSLSVSLGERTTINCKSSQSVLDSSTNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 290 - DNA, 1515 bp, Artificial Sequence
  CD33 F2 HL x F12Q HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagacaaactatgctgataagttccagggacgcgttaccttcacttcggatacctctaccagcactgcctatatggaactccgcaacctcaaaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgtctgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 291 - protein, 505 aa, Artificial Sequence
  CD33 F2 HL x I2C HL
QVQLVQSGAEVKKPGESVKVSCKASGYTFTNYGMNWVKQAPGQGLEWMGWINTYTGETNYADKFQGRVTFTSDTSTSTAYMELRNLKSDDTAVYYCARWSWSDGYYVYFDYWGQGTTVTVSSGGGGSGGGGSGGGGSDIVMTQSPDSLSVSLGERTTINCKSSQSVLDSSTNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 292 - DNA, 1515 bp, Artificial Sequence
  CD33 F2 HL x I2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagacaaactatgctgataagttccagggacgcgttaccttcacttcggatacctctaccagcactgcctatatggaactccgcaacctcaaaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgtctgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 293 - protein, 505 aa, Artificial Sequence
  CD33 B10 HL x H2C HL
QVQLVQSGAEVKKPGESVKVSCKASGYTFTNYGMNWVKQAPGQGLEWMGWINTYTGEPTYADKFQGRVTMTTDTSTSTAYMEIRNLRSDDTAVYYCARWSWSDGYYVYFDYWGQGTTVTVSSGGGGSGGGGSGGGGSDIVMTQSPDSLTVSLGERTTINCKSSQSVLDSSNNKNSLAWYQQKPGQPPKLLLSWASTRESGIPDRFSGSGSGTDFTLTIDGLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 294 - DNA, 1515 bp, Artificial Sequence
  CD33 B10 HL x H2C HL
caggtgcagctggtgcagtctggagctgaggtgaagaagcctggtgagtcagtcaaggtctcctgcaaggctagcgggtataccttcacaaactatggaatgaactgggtgaagcaggctccaggacagggtttagagtggatgggctggataaacacctacactggagagccaacctatgctgataagttccagggacgcgttaccatgactacggatacctctaccagcactgcctatatggaaatccgcaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaacaataagaactccttagcttggtaccagcagaaaccaggacagcctcctaaattactcctttcctgggcatctacgcgggaatccgggatccctgaccgattcagtggcagcggttctgggacagatttcactctcactattgacggcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 295 - protein, 505 aa, Artificial Sequence
  CD33 B10 HL x F12Q HL
QVQLVQSGAEVKKPGESVKVSCKASGYTFTNYGMNWVKQAPGQGLEWMGWINTYTGEPTYADKFQGRVTMTTDTSTSTAYMEIRNLRSDDTAVYYCARWSWSDGYYVYFDYWGQGTTVTVSSGGGGSGGGGSGGGGSDIVMTQSPDSLTVSLGERTTINCKSSQSVLDSSNNKNSLAWYQQKPGQPPKLLLSWASTRESGIPDRFSGSGSGTDFTLTIDGLQPEDSATYYCQQSAHFPITFGQGTRLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 296 - DNA, 1515 bp, Artificial Sequence
  CD33 B10 HL x F12Q HL
caggtgcagctggtgcagtctggagctgaggtgaagaagcctggtgagtcagtcaaggtctcctgcaaggctagcgggtataccttcacaaactatggaatgaactgggtgaagcaggctccaggacagggtttagagtggatgggctggataaacacctacactggagagccaacctatgctgataagttccagggacgcgttaccatgactacggatacctctaccagcactgcctatatggaaatccgcaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaacaataagaactccttagcttggtaccagcagaaaccaggacagcctcctaaattactcctttcctgggcatctacgcgggaatccgggatccctgaccgattcagtggcagcggttctgggacagatttcactctcactattgacggcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 297 - protein, 505 aa, Artificial Sequence
  CD33 B10 HL x I2C HL
QVQLVQSGAEVKKPGESVKVSCKASGYTFTNYGMNWVKQAPGQGLEWMGWINTYTGEPTYADKFQGRVTMTTDTSTSTAYMEIRNLRSDDTAVYYCARWSWSDGYYVYFDYWGQGTTVTVSSGGGGSGGGGSGGGGSDIVMTQSPDSLTVSLGERTTINCKSSQSVLDSSNNKNSLAWYQQKPGQPPKLLLSWASTRESGIPDRFSGSGSGTDFTLTIDGLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 298 - DNA, 1515 bp, Artificial Sequence
  CD33 B10 HL x I2C HL
caggtgcagctggtgcagtctggagctgaggtgaagaagcctggtgagtcagtcaaggtctcctgcaaggctagcgggtataccttcacaaactatggaatgaactgggtgaagcaggctccaggacagggtttagagtggatgggctggataaacacctacactggagagccaacctatgctgataagttccagggacgcgttaccatgactacggatacctctaccagcactgcctatatggaaatccgcaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaacaataagaactccttagcttggtaccagcagaaaccaggacagcctcctaaattactcctttcctgggcatctacgcgggaatccgggatccctgaccgattcagtggcagcggttctgggacagatttcactctcactattgacggcctgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 299 - protein, 505 aa, Artificial Sequence
  CD33 E11 HL x H2C HL
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 300 - DNA, 1515 bp, Artificial Sequence
  CD33 E11 HL x H2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagccaacctatgctgataagttccagggacgcgttaccatgactacggatacctctaccagcactgcctatatggaaatccgcaacctcggaggtgatgacacggctgtatattactgtgcgcgctggagttggagtgatggttactacgtttactttgactactggggccaaggcacttcggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcccgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 301 - protein, 505 aa, Artificial Sequence
  CD33 E11 HL x F12Q HL
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 302 - DNA, 1515 bp, Artificial Sequence
  CD33 E11 HL x F12Q HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagccaacctatgctgataagttccagggacgcgttaccatgactacggatacctctaccagcactgcctatatggaaatccgcaacctcggaggtgatgacacggctgtatattactgtgcgcgctggagttggagtgatggttactacgtttactttgactactggggccaaggcacttcggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcccgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 303 - protein, 505 aa, Artificial Sequence
  CD33 E11 HL x I2C HL
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 304 - DNA, 1515 bp, Artificial Sequence
  CD33 E11 HL x I2C HL
caggtgcagctggtgcagtctggagctgaggtgaagaagcctggagagtcagtcaaggtctcctgcaaggctagcgggtataccttcacaaactatggaatgaactgggtgaagcaggctccaggacagggtttagagtggatgggctggataaacacctacactggagagccaacctatgctgataagttccagggacgcgttaccatgactacggatacctctaccagcactgcctatatggaaatccgcaacctcggaggtgatgacacggctgtatattactgtgcgcgctggagttggagtgatggttactacgtttactttgactactggggccaaggcacttcggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccacgaataagaactccttagcttggtaccagcagaaaccaggacagcctcctaaattactcctttcctgggcatctacgcgggaatccgggatccctgaccgattcagtggcagcgggtctgggacagatttcactctcactattgacagcccgcagcctgaagattctgcaacttactattgtcaacagtctgcccacttcccgatcacctttggccaagggacacgactggagattaaatccggaggtggtggctccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 305 - DNA, 1125 bp, Homo sapiens
atgggatggagctgtatcatcctcttcttggtagcaacagctacaggtgtacactccgatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaagtccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtccgggcatcatcaccatcatcattga

SEQ ID NO: 306 - protein, 374 aa, Homo sapiens
MGWSCIILFLVATATGVHSDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQSGHHHHHH

SEQ ID NO: 307 - DNA, 1083 bp, Macaca sp.
atgccgctgctgctactgctgcccctgctgtgggcaggggccctggctatggatccaagagtcaggctggaagtgcaggagtcagtgacagtacaggagggtttgtgcgtccttgtgccctgcactttcttccatcccgtaccctaccacaccaggaattccccagttcatggttactggttccgggaaggagccattgtatccttggactctccagtggccacaaacaagctagatcaagaagtacaggaggagacccagggccgattccgcctccttggggatcccagtaggaacaactgctccctgagcatcgtagatgccaggaggagggataacggttcatacttctttcggatggagaaaggaagtaccaaatacagttacaaatctacccagctctctgtgcatgtgacagacttgacccacaggccccaaatcctcatccctggagccctagaccctgaccactccaaaaacctgacctgctctgtgccctgggcctgtgagcagggaacacctccaatcttctcctggatgtcagctgcccccacctccctgggcctcaggaccactcactcctcggtgctcataatcaccccacggccccaggaccacggcaccaacctcacctgtcaggtgaagttccctggagctggcgtgaccacggagagaaccatccagctcaatgtctcctatgcttcacagaacccaagaactgatatctttctaggagacggctcagggaaacaaggagtggttcagggagccatcgggggagctggtgtcacagtcctgctcgctctttgtctctgcctcatcttcttcacagtgaagactcacaggaggaaagcagccaggacagcagtgggcaggatcgacacccaccccgccacagggccaacatcctcgaaacaccagaagaagtccaagttacatggcgccactgaaacctcaggctgttcaggtaccacccttactgtggagatggatgaggagctgcactacgcttccctcaactttcatgggatgaatccttctgaggacacctccaccgaatactcagaggtcaggacccagtga

SEQ ID NO: 308 - protein, 360 aa, Macaca sp.
MPLLLLLPLLWAGALAMDPRVRLEVQESVTVQEGLCVLVPCTFFHPVPYHTRNSPVHGYWFREGAIVSLDSPVATNKLDQEVQEETQGRFRLLGDPSRNNCSLSIVDARRRDNGSYFFRMEKGSTKYSYKSTQLSVHVTDLTHRPQILIPGALDPDHSKNLTCSVPWACEQGTPPIFSWMSAAPTSLGLRTTHSSVLIITPRPQDHGTNLTCQVKFPGAGVTTERTIQLNVSYASQNPRTDIFLGDGSGKQGVVQGAIGGAGVTVLLALCLCLIFFTVKTHRRKAARTAVGRIDTHPATGPTSSKHQKKSKLHGATETSGCSGTTLTVEMDEELHYASLNFHGMNPSEDTSTEYSEVRTQ

SEQ ID NO: 309 - DNA, 843 bp, Artificial Sequence
  1-27 CD3-Fc + Leader
atgggatggagctgtatcatcctcttcttggtagcaacagctacaggtgtacactcccaagatggtaatgaagaaatgggtggtattacacagacaccatataaagtctccatctctggaaccacagtaatattgacatccggagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaatag

SEQ ID NO: 310 - protein, 280 aa, Artificial Sequence
  1-27 CD3-Fc + Leader
MGWSCIILFLVATATGVHSQDGNEEMGGITQTPYKVSISGTTVILTSGEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 505 aa, Artificial Sequence
  CD33 UD H2C HL x AF5 HL
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVLSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIK

SEQ ID NO: 312 - DNA, 1515 bp, Artificial Sequence
  CD33 UD H2C HL x AF5 HL
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtcctatccggaggtggtggctcccaggtgcagctggtccagtctggagctgaggtgaagaagcctggagcgtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatttggaactccacaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaa

SEQ ID NO: 313 - protein, 505 aa, Artificial Sequence
  CD33 UD F12Q HL x AF5 HL
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIK

SEQ ID NO: 314 - DNA, 1515 bp, Artificial Sequence
  CD33 UD F12Q HL x AF5 HL
gaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcctatccggaggtggtggctcccaggtgcagctggtccagtctggagctgaggtgaagaagcctggagcgtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatttggaactccacaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaa

SEQ ID NO: 315 - protein, 505 aa, Artificial Sequence
  CD33 UD I2C HL x AF5 HL
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIK

SEQ ID NO: 316 - DNA, 1515 bp, Artificial Sequence
  CD33 UD I2C HL x AF5 HL
gaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtcctatccggaggtggtggctcccaggtgcagctggtccagtctggagctgaggtgaagaagcctggagcgtcagtcaaggtctcctgcaaggctagcgggtataccttcacaaactatggaatgaactgggtgaagcaggctccaggacagggtttaaagtggatgggctggataaacacctacactggagagccaacatatgctgatgacttcaagggacgggttaccatgacttcggatacctctaccagcactgcctatttggaactccacaacctcagaagtgatgacacggctgtatattactgtgcgcgctggagttggagtgatggttactacgtttactttgactactggggccaaggcactacggtcaccgtctcctcaggtggtggtggttctggcggcggcggctccggtggtggtggttctgacatcgtgatgacacagtctccagactccctgactgtgtctctgggcgagaggaccaccatcaactgcaagtccagccagagtgttttagacagctccaagaataagaactccttagcttggtaccagcagaaaccaggacagcctcctaaattactcctttcctgggcatctacgcgggaatccgggatccctgaccgattcagtggcagcgggtctgggacagatttcactctcactattgacagcctgcagcctgaagattctgcaacttactattgtcaacagtctgcccacttcccgatcacctttggccaagggacacgactggagattaaa

SEQ ID NO: 317 - protein, 500 aa, Artificial Sequence
  MCSP-A9 HL x H2C HL
QVQLVQSGAEVKKPGASVKVSCKASGYPFTGYYMHWVRQAPGQGLEWMGWINPNSGGTNYAQKFQGRVTITADESTSTAYMELSRLRSDDTAVYYCAKSWVSWFASWGQGTLVTVSSGGGGSGGGGSGGGGSDIVMTQSPDSLAVSLGERATINCKSSQSVLSSSNNKNYLNWYQQKPGQPPKLLIYWASTRESGVPDRFSGSGSGTDFTLTISSLQAEDVAVYYCQQHFNTPFAFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 318 - DNA, 1500 bp, Artificial Sequence
  MCSP-A9 HL x H2C HL
caggtgcagctggtccagtctggggctgaggtgaagaagcctggggcctcagtgaaggtctcctgcaaggcttctggataccccttcaccggctactacatgcactgggtgcgacaggcccctggacaagggcttgagtggatgggatggatcaaccctaacagtggtggcacaaactatgcacagaagtttcagggcagagtcacgattaccgcggacgaatccacgagcacagcctacatggagctgagcaggctgagatctgacgacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacacagtctccagactccctggctgtgtctctgggcgagagggccaccatcaactgcaagtccagccagagtgtcttatccagctccaacaataagaactacttaaattggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcggtttattactgtcaacaacattttaatactccgttcgcttttggccaggggaccaagctggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 319 - protein, 500 aa, Artificial Sequence
  MCSP-A9 HL x F12Q HL
QVQLVQSGAEVKKPGASVKVSCKASGYPFTGYYMHWVRQAPGQGLEWMGWINPNSGGTNYAQKFQGRVTITADESTSTAYMELSRLRSDDTAVYYCAKSWVSWFASWGQGTLVTVSSGGGGSGGGGSGGGGSDIVMTQSPDSLAVSLGERATINCKSSQSVLSSSNNKNYLNWYQQKPGQPPKLLIYWASTRESGVPDRFSGSGSGTDFTLTISSLQAEDVAVYYCQQHFNTPFAFGQGTKLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 320 - DNA, 1500 bp, Artificial Sequence
  MCSP-A9 HL x F12Q HL
caggtgcagctggtccagtctggggctgaggtgaagaagcctggggcctcagtgaaggtctcctgcaaggcttctggataccccttcaccggctactacatgcactgggtgcgacaggcccctggacaagggcttgagtggatgggatggatcaaccctaacagtggtggcacaaactatgcacagaagtttcagggcagagtcacgattaccgcggacgaatccacgagcacagcctacatggagctgagcaggctgagatctgacgacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacacagtctccagactccctggctgtgtctctgggcgagagggccaccatcaactgcaagtccagccagagtgtcttatccagctccaacaataagaactacttaaattggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcggtttattactgtcaacaacattttaatactccgttcgcttttggccaggggaccaagctggagatcaaatccggaggtggtggatccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 321 - protein, 500 aa, Artificial Sequence
  MCSP-A9 HL x I2C HL
QVQLVQSGAEVKKPGASVKVSCKASGYPFTGYYMHWVRQAPGQGLEWMGWINPNSGGTNYAQKFQGRVTITADESTSTAYMELSRLRSDDTAVYYCAKSWVSWFASWGQGTLVTVSSGGGGSGGGGSGGGGSDIVMTQSPDSLAVSLGERATINCKSSQSVLSSSNNKNYLNWYQQKPGQPPKLLIYWASTRESGVPDRFSGSGSGTDFTLTISSLQAEDVAVYYCQQHFNTPFAFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 322 - DNA, 1500 bp, Artificial Sequence
  MCSP-A9 HL x I2C HL
caggtgcagctggtccagtctggggctgaggtgaagaagcctggggcctcagtgaaggtctcctgcaaggcttctggataccccttcaccggctactacatgcactgggtgcgacaggcccctggacaagggcttgagtggatgggatggatcaaccctaacagtggtggcacaaactatgcacagaagtttcagggcagagtcacgattaccgcggacgaatccacgagcacagcctacatggagctgagcaggctgagatctgacgacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacacagtctccagactccctggctgtgtctctgggcgagagggccaccatcaactgcaagtccagccagagtgtcttatccagctccaacaataagaactacttaaattggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcggtttattactgtcaacaacattttaatactccgttcgcttttggccaggggaccaagctggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 323 - protein, 500 aa, Artificial Sequence
  MCSP-C8 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGERATINCKSSQSVLNSKNNRNYLAWYQQKPGQPPKLLIYWASTRESGVPDRFSGSGSGTDFTLTISGLQAEDVAVYYCQQHYSTPFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 324 - DNA, 1500 bp, Artificial Sequence
  MCSP-C8 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctggctgtgtctctgggcgagagggccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcagtggcctgcaggctgaagatgtggcagtttattactgtcagcaacattatagtactccattcacttttggccctgggaccaaagtggatatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 325 - protein, 500 aa, Artificial Sequence
  MCSP-B8 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLTVSPGERATINCKSSQSVLNSKNNRNYLAWYQQKPGQPPKLLIYWASTRESGVPDRFSGSGSGTDFTLTIDSLQPEDSATYYCQQHYSTPFTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 326 - DNA, 1500 bp, Artificial Sequence
  MCSP-B8 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctgactgtgtctccgggcgagagggccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcgattccctgcagcctgaagatagtgcaacttattactgtcagcaacattatagtactccattcacttttggccaggggaccagactggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 327 - protein, 500 aa, Artificial Sequence
  MCSP-B7 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLTVSLGERTTINCKSSQSVLNSKNNRNYLAWYQQKPGQPPKLLIYWASTRESGVPDRFSGSGSGTDFTLTIDSLQPEDIATYYCQQHYSTPFTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 328 - DNA, 1500 bp, Artificial Sequence
  MCSP-B7 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctgactgtgtctctgggcgagaggaccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcgattccctgcagcctgaagatattgcaacttattactgtcagcaacattatagtactccattcacttttggccaggggaccagactggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 329 - protein, 500 aa, Artificial Sequence
  MCSP-G8 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLTVSLGERATINCKSSQSVLNSKNNRNYLAWYQQKPGQPPKLLIYWASTRESGVPDRFSGSGSGTDFTLTIDSLQPEDSATYYCQQHYSTPFTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 330 - DNA, 1500 bp, Artificial Sequence
  MCSP-G8 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctgactgtgtctctgggcgagagggccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcgattccctgcagcctgaagatagtgcaacttattactgtcagcaacattatagtactccattcacttttggccaggggaccagactggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 331 - protein, 500 aa, Artificial Sequence
  MCSP-D5 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGERATINCKSSQSVLNSKNNRNYLAWYQQKPGQPPKLLIYWASTRESGVPDRFSGSGSGTDFTLTIDSLQAEDSATYYCQQHYSTPFTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 332 - DNA, 1500 bp, Artificial Sequence
  MCSP-D5 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctggctgtgtctctgggcgagagggccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcgattccctgcaggctgaagatagtgcaacttattactgtcagcaacattatagtactccattcacttttggccaggggaccagactggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 333 - protein, 500 aa, Artificial Sequence
  MCSP-F7 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGERATINCKSSQSVLNSKNNRNYLAWYQQKPGQPPKLLIYWASTRESGVPDRFSGSGSGTDFTLTIDVLQPEDIATYYCQQHYSTPFTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 334 - DNA, 1500 bp, Artificial Sequence
  MCSP-F7 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctggctgtgtctctgggcgagagggccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcgatgtcctgcagcctgaagatattgcaacttattactgtcagcaacattatagtactccattcacttttggccaggggaccagactggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 335 - protein, 500 aa, Artificial Sequence
  MCSP-G5 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGDRATINCKSSQSVLNSKNNRNYLAWYQQKPGQPPKLLIYWASTRESGVPDRFSGSGSGTDFTLTIDSLQPEDSATYYCQQHYSTPFTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 336 - DNA, 1500 bp, Artificial Sequence
  MCSP-G5 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctggctgtgtctctgggcgacagggccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcgattccctgcagcctgaggatagtgcaacttattactgtcagcaacattatagtactccattcacttttggccaggggaccagactggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 337 - protein, 500 aa, Artificial Sequence
  MCSP-F8 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLTVSLGERATINCKSSQSVLNSKNNRNYLAWYQQKPGQPPKLLIYWASTRESGVPDRFSGSGSGTDFTLTIDSLQAEDSAIYYCQQHYSTPFTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 338 - DNA, 1500 bp, Artificial Sequence
  MCSP-F8 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacccagtctccagactccctgactgtgtctctgggcgagagggccaccatcaactgcaagtccagccagagtgttttaaacagcaagaacaataggaactacttagcttggtaccagcagaaaccaggacagcctcctaagctgctcatttactgggcatctacccgggaatccggggtccctgaccgattcagtggcagcgggtctgggacagatttcactctcaccatcgattccctgcaggctgaagatagtgcaatttattactgtcagcaacattatagtactccattcacttttggccaggggaccagactggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 339 - protein, 500 aa, Artificial Sequence
  MCSP-G10 HL x I2C HL
QVQLVQSGAEVKRPGASMKVSCKASGYTFTNYYIHWVRQAPGQGLEWMGWINPNSGATNYAQKFQGRVTMTRDTSTSTVYMELSSLRSEDTAVYYCAKSWVSWFASWGQGTLVTVSSGGGGSGGGGSGGGGSDIVMTQSPDSLAVSLGERATINCKSSQSVLSSSNNKNYLNWYQQKPGQPPKLLIYWASTRESGVPDRFSGSGSGTDFTLTISSLQAEDVAVYYCQQHFNTPFAFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 340 - DNA, 1500 bp, Artificial Sequence
  MCSP-G10 HL x I2C HL
caggtgcagctggtccagtctggggctgaggtgaagaggcctggggcctcaatgaaggtctcctgcaaggcttctgggtacaccttcaccaactactatatacactgggtgcgacaggcccctggacaaggtcttgagtggatgggttggatcaaccctaacagtggtgccacaaactatgcacagaagttccagggcagagtcaccatgaccagggacacgtccacgagcacagtctacatggagctgagcagcctgagatctgaggacacggccgtgtattactgtgcgaaatcctgggtctcctggtttgcttcctggggtcaaggaaccttggtcaccgtctcctcaggtggtggtggttctggcggcggcggctccggtggtggtggttctgacatcgtgatgacacagtctccagactccctggctgtgtctctgggcgagagggccaccatcaactgcaagtccagccagagtgtcttatccagctccaacaataagaactacttaaattggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcggtttattactgtcaacaacattttaatactccgttcgcttttggccaggggaccaagctggagatcaaatccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 341 - protein, 8 aa, Homo sapiens
QDGNEEMG

SEQ ID NO: 342 - protein, 8 aa, Saimiri sciureus
QDGNEEIG

SEQ ID NO: 343 - DNA, 20 bp, Artificial Sequence
  Thioate-modified CpG-Oligonucleotide
tccatgacgttcctgatgct

SEQ ID NO: 344 - DNA, 28 bp, Artificial Sequence
  MVH1
gcaggtgcagctcgaggagtcaggacct

SEQ ID NO: 345 - DNA, 27 bp, Artificial Sequence
  MVH2
gaggtccagctcgagcagtctggacct

SEQ ID NO: 346 - DNA, 27 bp, Artificial Sequence
  MVH3
caggtccaactcgagcagcctggggct

SEQ ID NO: 347 - DNA, 27 bp, Artificial Sequence
  MVH4
gaggttcagctcgagcagtctggggca

SEQ ID NO: 348 - DNA, 28 bp, Artificial Sequence
  MVH5
gaaggtgaagctcgaggagtctggagga

SEQ ID NO: 349 - DNA, 27 bp, Artificial Sequence
  MVH6
gaggtgaagcttctcgagtctggaggt

SEQ ID NO: 350 - DNA, 27 bp, Artificial Sequence
  MVH7
gaagtgaagctcgaggagtctggggga

SEQ ID NO: 351 - DNA, 27 bp, Artificial Sequence
  MVH8
gaggttcagctcgagcagtctggagct

SEQ ID NO: 352 - DNA, 34 bp, Artificial Sequence
  MuVHBstEII
tgaggagacggtgaccgtggtcccttggccccag

SEQ ID NO: 353 - DNA, 32 bp, Artificial Sequence
  MUVK1
ccagttccgagctcgttgtgactcaggaatct

SEQ ID NO: 354 - DNA, 32 bp, Artificial Sequence
  MUVK2
ccagttccgagctcgtgttgacgcagccgccc

SEQ ID NO: 355 - DNA, 32 bp, Artificial Sequence
  MUVK3
ccagttccgagctcgtgctcacccagtctcca

SEQ ID NO: 356 - DNA, 32 bp, Artificial Sequence
  MUVK4
ccagttccgagctccagatgacccagtctcca

SEQ ID NO: 357 - DNA, 32 bp, Artificial Sequence
  MUVK5
ccagatgtgagctcgtgatgacccagactcca

SEQ ID NO: 358 - DNA, 32 bp, Artificial Sequence
  MUVK6
ccagatgtgagctcgtcatgacccagtctcca

SEQ ID NO: 359 - DNA, 32 bp, Artificial Sequence
  MUVK7
ccagttccgagctcgtgatgacacagtctcca

SEQ ID NO: 360 - DNA, 39 bp, Artificial Sequence
  MuVkHindIII/BsiW1
tggtgcactagtcgtacgtttgatctcaagcttggtccc

SEQ ID NO: 361 - DNA, 22 bp, Artificial Sequence
  forward primer
gatctggtctacaccatcgagc

SEQ ID NO: 362 - DNA, 24 bp, Artificial Sequence
  reverse primer
ggagctgctgctggctcagtgagg

SEQ ID NO: 363 - DNA, 23 bp, Artificial Sequence
  forward primer
ttccagctgagcatgtctgatgg

SEQ ID NO: 364 - DNA, 21 bp, Artificial Sequence
  reverse primer
cgatcagcatctgggcccagg

SEQ ID NO: 365 - DNA, 25 bp, Artificial Sequence
  forward primer
gtggagcagttcactcagcaggacc

SEQ ID NO: 366 - DNA, 22 bp, Artificial Sequence
  reverse primer
gccttcacacccagtactggcc

SEQ ID NO: 367 - DNA, 59 bp, Artificial Sequence
  forward primer
tcccgtacgagatctggatcccaattggatggcggactcgtgctgttctcacacagagg

SEQ ID NO: 368 - DNA, 45 bp, Artificial Sequence
  reverse primer
agtgggtcgactcacacccagtactggccattcttaagggcaggg

SEQ ID NO: 369 - DNA, 64 bp, Artificial Sequence
  forward primer
gaggaattcaccatgccgctgctgctactgctgcccctgctgtgggcaggggccctggctatgg

SEQ ID NO: 370 - DNA, 26 bp, Artificial Sequence
  reverse primer
gatttgtaactgtatttggtacttcc

SEQ ID NO: 371 - DNA, 21 bp, Artificial Sequence
  forward primer
attccgcctccttggggatcc

SEQ ID NO: 372 - DNA, 25 bp, Artificial Sequence
  reverse primer
gcataggagacattgagctggatgg

SEQ ID NO: 373 - DNA, 21 bp, Artificial Sequence
  forward primer
gcaccaacctgacctgtcagg

SEQ ID NO: 374 - DNA, 39 bp, Artificial Sequence
  reverse primer
agtgggtcgactcactgggtcctgacctctgagtattcg

SEQ ID NO: 375 - protein, 124 aa, Artificial Sequence
  V EGFR 3D-E8
EVQLLESGGGLVQAGGSLRLSCAASGRTFSTYTMAWFRQAPGKEREFVQGISRSDGGTYDADSVKGRFTISRDNAKNTVYLQMNSLKPEDTAVYFCAAASVKLVYVNPNRYSYWGQGTQVTVSS

SEQ ID NO: 376 - protein, 5 aa, Artificial Sequence
  V EGFR 3D-E8 CDR1
TYTMA

SEQ ID NO: 377 - protein, 17 aa, Artificial Sequence
  V EGFR 3D-E8 CDR2
GISRSDGGTYDADSVKG

SEQ ID NO: 378 - protein, 15 aa, Artificial Sequence
  V EGFR 3D-E8 CDR3
ASVKLVYVNPNRYSY

SEQ ID NO: 379 - DNA, 372 bp, Artificial Sequence
  EGFR 3D-E8
gaggtgcagctgctcgagagcggtggtggtctggttcaggcgggtggcagcctgcgtctgagctgtgcggcgagcggccgtacctttagcacctataccatggcgtggtttcgtcaggcaccgggcaaagaacgtgaatttgtgcagggcattagccgtagcgatggcggcacctatgatgcggatagcgtgaaaggccgttttaccattagccgtgataacgcgaaaaacaccgtgtatctgcagatgaacagcctgaaaccggaagataccgcggtgtatttttgcgcggcagcgagcgtgaaactggtgtatgtgaatccgaaccgttatagctattggggccagggcacccaggtgaccgttagctcc

SEQ ID NO: 380 - protein, 378 aa, Artificial Sequence
  EGFR 3D-E8 x I2C HL
EVQLLESGGGLVQAGGSLRLSCAASGRTFSTYTMAWFRQAPGKEREFVQGISRSDGGTYDADSVKGRFTISRDNAKNTVYLQMNSLKPEDTAVYFCAAASVKLVYVNPNRYSYWGQGTQVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 381 - DNA, 1134 bp, Artificial Sequence
  EGFR 3D-E8 x I2C HL
gaggtgcagctgctcgagagcggtggtggtctggttcaggcgggtggcagcctgcgtctgagctgtgcggcgagcggccgtacctttagcacctataccatggcgtggtttcgtcaggcaccgggcaaagaacgtgaatttgtgcagggcattagccgtagcgatggcggcacctatgatgcggatagcgtgaaaggccgttttaccattagccgtgataacgcgaaaaacaccgtgtatctgcagatgaacagcctgaaaccggaagataccgcggtgtatttttgcgcggcagcgagcgtgaaactggtgtatgtgaatccgaaccgttatagctattggggccagggcacccaggtgaccgttagctccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 382 - protein, 378 aa, Artificial Sequence
  EGFR 3D-E8 x H2C HL
EVQLLESGGGLVQAGGSLRLSCAASGRTFSTYTMAWFRQAPGKEREFVQGISRSDGGTYDADSVKGRFTISRDNAKNTVYLQMNSLKPEDTAVYFCAAASVKLVYVNPNRYSYWGQGTQVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 383 - DNA, 1134 bp, Artificial Sequence
  EGFR 3D-E8 x H2C HL
gaggtgcagctgctcgagagcggtggtggtctggttcaggcgggtggcagcctgcgtctgagctgtgcggcgagcggccgtacctttagcacctataccatggcgtggtttcgtcaggcaccgggcaaagaacgtgaatttgtgcagggcattagccgtagcgatggcggcacctatgatgcggatagcgtgaaaggccgttttaccattagccgtgataacgcgaaaaacaccgtgtatctgcagatgaacagcctgaaaccggaagataccgcggtgtatttttgcgcggcagcgagcgtgaaactggtgtatgtgaatccgaaccgttatagctattggggccagggcacccaggtgaccgttagctccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 384 - protein, 378 aa, Artificial Sequence
  EGFR 3D-E8 x F12Q HL
EVQLLESGGGLVQAGGSLRLSCAASGRTFSTYTMAWFRQAPGKEREFVQGISRSDGGTYDADSVKGRFTISRDNAKNTVYLQMNSLKPEDTAVYFCAAASVKLVYVNPNRYSYWGQGTQVTVSSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 385 - DNA, 1134 bp, Artificial Sequence
  EGFR 3D-E8 x F12Q HL
gaggtgcagctgctcgagagcggtggtggtctggttcaggcgggtggcagcctgcgtctgagctgtgcggcgagcggccgtacctttagcacctataccatggcgtggtttcgtcaggcaccgggcaaagaacgtgaatttgtgcagggcattagccgtagcgatggcggcacctatgatgcggatagcgtgaaaggccgttttaccattagccgtgataacgcgaaaaacaccgtgtatctgcagatgaacagcctgaaaccggaagataccgcggtgtatttttgcgcggcagcgagcgtgaaactggtgtatgtgaatccgaaccgttatagctattggggccagggcacccaggtgaccgttagctccggaggtggtggatccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 386 - protein, 124 aa, Artificial Sequence
  V EGFR 3D-D12
EVQLLESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 387 - protein, 5 aa, Artificial Sequence
  V EGFR 3D-D12 CDR1
SYGMG

SEQ ID NO: 388 - protein, 17 aa, Artificial Sequence
  V EGFR 3D-D12 CDR2
GISWRGDSTGYADSVKG

SEQ ID NO: 389 - protein, 15 aa, Artificial Sequence
  V EGFR 3D-D12 CDR3
AAGSAWYGTLYEYDY

SEQ ID NO: 390 - DNA, 372 bp, Artificial Sequence
  V EGFR 3D-D12
gaggtgcagctgctcgagagcggtggtggtagcgtgcagaccggcggtagcctgcgtctgacctgtgcggcgagcggtcgtaccagccgtagctatggcatgggctggtttcgtcaggcaccgggcaaagaacgtgaatttgtgagcggcattagctggcgtggcgatagcaccggctatgcggatagcgtgaaaggccgttttaccattagccgtgataacgcgaaaaacaccgtggatctgcagatgaacagcctgaaaccggaagataccgcgatttattattgcgcggcagcggcgggtagcgcgtggtatggcaccctgtatgaatatgattattggggccagggcacccaggtgaccgttagctcc

SEQ ID NO: 391 - protein, 378 aa, Artificial Sequence
  V EGFR 3D-D12 x I2C HL
EVQLLESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 392 - DNA, 1134 bp, Artificial Sequence
  V EGFR 3D-D12 x I2C HL
gaggtgcagctgctcgagagcggtggtggtagcgtgcagaccggcggtagcctgcgtctgacctgtgcggcgagcggtcgtaccagccgtagctatggcatgggctggtttcgtcaggcaccgggcaaagaacgtgaatttgtgagcggcattagctggcgtggcgatagcaccggctatgcggatagcgtgaaaggccgttttaccattagccgtgataacgcgaaaaacaccgtggatctgcagatgaacagcctgaaaccggaagataccgcgatttattattgcgcggcagcggcgggtagcgcgtggtatggcaccctgtatgaatatgattattggggccagggcacccaggtgaccgttagctccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 393 - protein, 378 aa, Artificial Sequence
  V EGFR 3D-D12 x H2C HL
EVQLLESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 394 - DNA, 1134 bp, Artificial Sequence
  V EGFR 3D-D12 x H2C HL
gaggtgcagctgctcgagagcggtggtggtagcgtgcagaccggcggtagcctgcgtctgacctgtgcggcgagcggtcgtaccagccgtagctatggcatgggctggtttcgtcaggcaccgggcaaagaacgtgaatttgtgagcggcattagctggcgtggcgatagcaccggctatgcggatagcgtgaaaggccgttttaccattagccgtgataacgcgaaaaacaccgtggatctgcagatgaacagcctgaaaccggaagataccgcgatttattattgcgcggcagcggcgggtagcgcgtggtatggcaccctgtatgaatatgattattggggccagggcacccaggtgaccgttagctccggaggtggtggatccgaggtgcagctggtcgagtctggaggaggattggtgcagcctggagggtcattgaaactctcatgtgcagcctctggattcaccttcaataagtacgccatgaactgggtccgccaggctccaggaaagggtttggaatgggttgctcgcataagaagtaaatataataattatgcaacatattatgccgattcagtgaaagacaggttcaccatctccagagatgattcaaaaaacactgcctatctacaaatgaacaacttgaaaactgaggacactgccgtgtactactgtgtgagacatgggaacttcggtaatagctacatatcctactgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggctactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgctctatggtacagcaaccgctgggtgttcggtggaggaaccaaactgactgtccta

SEQ ID NO: 395 - protein, 378 aa, Artificial Sequence
  V EGFR 3D-D12 x F12Q HL
EVQLLESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 396 - DNA, 1134 bp, Artificial Sequence
  V EGFR 3D-D12 x F12Q HL
gaggtgcagctgctcgagagcggtggtggtagcgtgcagaccggcggtagcctgcgtctgacctgtgcggcgagcggtcgtaccagccgtagctatggcatgggctggtttcgtcaggcaccgggcaaagaacgtgaatttgtgagcggcattagctggcgtggcgatagcaccggctatgcggatagcgtgaaaggccgttttaccattagccgtgataacgcgaaaaacaccgtggatctgcagatgaacagcctgaaaccggaagataccgcgatttattattgcgcggcagcggcgggtagcgcgtggtatggcaccctgtatgaatatgattattggggccagggcacccaggtgaccgttagctccggaggtggtggatccgaggtgcagctggtcgagtctggaggaggattggtgcagcctggagggtcattgaaactctcatgtgcagcctctggattcaccttcaatagctacgccatgaactgggtccgccaggctccaggaaagggtttggaatgggttgctcgcataagaagtaaatataataattatgcaacatattatgccgattcagtgaaaggcaggttcaccatctccagagatgattcaaaaaacactgcctatctacaaatgaacaacttgaaaactgaggacactgccgtgtactactgtgtgagacatgggaacttcggtaatagctacgtttcctggtgggcttactggggccaagggactctggtcaccgtctcctcaggtggtggtggttctggcggcggcggctccggtggtggtggttctcagactgttgtgactcaggaaccttcactcaccgtatcacctggtggaacagtcacactcacttgtggctcctcgactggggctgttacatctggcaactacccaaactgggtccaacaaaaaccaggtcaggcaccccgtggtctaataggtgggactaagttcctcgcccccggtactcctgccagattctcaggctccctgcttggaggcaaggctgccctcaccctctcaggggtacagccagaggatgaggcagaatattactgtgttctatggtacagcaaccgctgggtgttcggtggaggaaccaaactgactgtccta

SEQ ID NO: 397 - protein, 126 aa, Artificial Sequence
  V CD3 3D-H11
EVQLLEEVQLVESGGGLVQPGGSLRLSCAASGFTFDDYGMSWVRQAPGKWLEWVSDISWNGGSTYYADSVKGRFTISRDNAENTLYLQMNSLKPDDTAVYYCAKMGEGGWGANDYWGQGTQVTVSS

SEQ ID NO: 398 - protein, 5 aa, Artificial Sequence
  V CD3 3D-H11 CDR1
DYGMS

SEQ ID NO: 399 - protein, 17 aa, Artificial Sequence
  V CD3 3D-H11 CDR2
DISWNGGSTYYADSVKG

SEQ ID NO: 400 - protein, 11 aa, Artificial Sequence
  V CD3 3D-H11 CDR3
MGEGGWGANDY

SEQ ID NO: 401 - DNA, 378 bp, Artificial Sequence
  V CD3 3D-H11
gaggtgcagctgctcgaggaggtgcagctggtggagtctgggggaggcttggtgcagcctggggggtctctgagactctcctgtgcagcctctggattcacttttgatgattatggcatgagctgggtccgacaggctccagggaagtggctggagtgggtctcagatattagctggaatggtggtagcacatactatgcagactccgtgaagggccggttcaccatctccagagacaacgccgagaacacgctgtatctgcaaatgaacagcctgaaacctgacgacacggccgtgtattactgtgcaaaaatgggtgaagggggatggggtgcaaatgactactggggccaggggacccaggtcaccgtctcctcc

SEQ ID NO: 402 - DNA, 34 bp, Artificial Sequence
  5' EGFR AG XbaI
ggtctagagcatgcgaccctccgggacggccggg

SEQ ID NO: 403 - DNA, 36 bp, Artificial Sequence
  3' EGFR AG SalI
ttttaagtcgactcatgctccaataaattcactgct

SEQ ID NO: 404 - DNA, 22 bp, Artificial Sequence
  Forward primer
cgctctgcccggcgagtcgggc

SEQ ID NO: 405 - DNA, 22 bp, Artificial Sequence
  Reverse primer
ccgtcttcctccatctcatagc

SEQ ID NO: 406 - DNA, 31 bp, Artificial Sequence
  Forward primer
acatccggaggtgacagatcacggctcgtgc

SEQ ID NO: 407 - DNA, 30 bp, Artificial Sequence
  Reverse primer
caggatatccgaacgatgtggcgccttcgc

SEQ ID NO: 408 - DNA, 35 bp, Artificial Sequence
  5'-VHHa-XhoI
ctgacgctcgaggaggtgcagctggtggagtctgg

SEQ ID NO: 409 - DNA, 35 bp, Artificial Sequence
  5'-VHHb-XhoI
ctgacgctcgagcaggtrcagctggtggagtctgg

SEQ ID NO: 410 - DNA, 35 bp, Artificial Sequence
  5'-VHHc-XhoI
ctgacgctcgagcaggtaaagctggaggagtctgg

SEQ ID NO: 411 - DNA, 35 bp, Artificial Sequence
  5'-VHHd-XhoI
ctgacgctcgaggatgtgcagctggtggagtctgg

SEQ ID NO: 412 - DNA, 35 bp, Artificial Sequence
  5'-VHHe-XhoI
ctgacgctcgaggccgtgcagctggtggattctgg

SEQ ID NO: 413 - DNA, 32 bp, Artificial Sequence
  5'-VHHf-XhoI
acgctcgaggcggtgcagctggtggagtctgg

SEQ ID NO: 414 - DNA, 34 bp, Artificial Sequence
  5'-VHH-LP-A-XhoI
ctgacgctcgaggaggtgcagctgcaggcgtctg

SEQ ID NO: 415 - DNA, 34 bp, Artificial Sequence
  5'-VHH-LP-B-XhoI
ctgacgctcgaggatgtscagctgcaggcgtctg

SEQ ID NO: 416 - DNA, 35 bp, Artificial Sequence
  5'-VHH-LX-I-XhoI
ctgacgctcgagcaggtgcagctggtgcagtctgg

SEQ ID NO: 417 - DNA, 35 bp, Artificial Sequence
  5'-VHH-LX-II-XhoI
ctgacgctcgagcaggtcaccttgaaggagtctgg

SEQ ID NO: 418 - DNA, 35 bp, Artificial Sequence
  5'-VHH-LX-III-XhoI
ctgacgctcgagcaggtgcagctgcaggagtcggg

SEQ ID NO: 419 - DNA, 32 bp, Artificial Sequence
  5'-VHH-LG-1-XhoI
ctgacgctcgagctgcagcagtctgggggagg

SEQ ID NO: 420 - DNA, 38 bp, Artificial Sequence
  3'-VHHG2-BsiWI-SpeI
ctgacgactagtcgtacgttggggtatcttgggttctg

SEQ ID NO: 421 - DNA, 40 bp, Artificial Sequence
  3'-VHHG3-BsiWI-SpeI
ctgacgactagtcgtacgtacttcattcgttcctgavgag

SEQ ID NO: 422 - DNA, 42 bp, Artificial Sequence
  3'-VHH-LP-G2a-BsiWI-SpeI
ctgacgactagtcgtacgttgtggttttggtgtcttgggttc

SEQ ID NO: 423 - DNA, 41 bp, Artificial Sequence
  3'-VHH-LP-dirA-BsiWI-SpeI
ctgacgactagtcgtacgtgaggagacggtgacctgggtcc

SEQ ID NO: 424 - DNA, 38 bp, Artificial Sequence
  3'-VHH-LG-dir1-BsiWI-SpeI
ctgacgactagtcgtacgggtgacctgggtcccctggc

SEQ ID NO: 425 - protein, 28 aa, Artificial Sequence
  N-termina 1-27 + additional C at position 28
QDGNEEMGGITQTPYKVSISGTTVILTC

SEQ ID NO: 426 - protein, 7 aa, Artificial Sequence
  Flag-tag
YKDDDDK

SEQ ID NO: 427 - protein, 27 aa, Macaca fascicularis
QDGNEEMGSITQTPYQVSISGTTILTC

SEQ ID NO: 428 - protein, 27 aa, Macaca fascicularis
QDGNEEMGSITQTPYQVSISGTTVILT

SEQ ID NO: 429 - protein, 27 aa, Macaca mulatta
QDGNEEMGSITQTPYHVSISGTTVILT

SEQ ID NO: 430 - protein, 5 aa, Artificial Sequence
  Synthetic Primer
QDGNE

SEQ ID NO: 431 - protein, 5 aa, Artificial Sequence
  Polypeptide spacer
GGGGS

SEQ ID NO: 432 - protein, 8 aa, Artificial Sequence
  Polypeptide
  VARIANT (7)..(7): "X" is Met or Ile
QDGNEEXG

SEQ ID NO: 433 - protein, 10 aa, Artificial Sequence
  pComb3H5BHis Flag-tag
TGDYKDDDDK

SEQ ID NO: 434 - protein, 9 aa, Artificial Sequence
  Artificial linker
SRTRSGSQL

SEQ ID NO: 435 - protein, 15 aa, Artificial Sequence
  VH target -(Gly4Ser1)3
GGGGSGGGGSGGGGS

SEQ ID NO: 436 - protein, 6 aa, Artificial Sequence
  C-terminal His6 tag
HHHHHH

The invention claimed is:

1. A nucleic acid comprising a polynucleotide encoding a bispecific single chain antibody molecule comprising a first binding domain which binds to an epitope of a human CD3 epsilon (CD3ε) chain, wherein the epitope is part of the amino acid sequence set forth in SEQ ID NO: 2, 4, 6, or 8, and comprises at least the amino acid sequence Gln-Asp-Gly-Asn-Glu (QDGNE; SEQ ID NO: 430), and a second binding domain comprising an antibody variable domain that is cross-species specific and binds to an epitope of a human and a non-chimpanzee primate tumor target antigen, wherein the first binding domain is a VHH domain and comprises CDR 1 of SEQ ID NO: 398, CDR 2 of SEQ ID NO: 399 and CDR 3 of SEQ ID. NO: 400.

2. The nucleic acid of claim 1, wherein the first binding domain further binds a *Callithrix jacchus, Sanguinis oedipus* or *Saimiri sciureus* CD3ε chain.

3. The nucleic acid of claim 1, wherein at least one of said first or second binding domain is CDR-grafted, humanized or human.

4. The nucleic acid of claim 1, wherein the first binding domain comprises an antibody variable domain comprising:
  (a) the amino acid sequence of SEQ ID NO. 397;
  (b) an amino acid sequence encoded by the nucleotide sequence of SEQ ID NO: 401;
  (c) an amino acid sequence at least 80% identical to the amino acid sequence of SEQ ID NO: 397 or the amino acid sequence encoded by the nucleotide sequence of SEQ ID NO: 401; or
  (d) an amino acid sequence at least 90% identical to the amino acid sequence of SEQ ID NO: 397 or the amino acid sequence encoded by the nucleotide sequence of SEQ ID NO: 401.

5. The nucleic acid of claim 1, wherein the antibody variable domain of the second binding domain comprises CDR1-3 selected from the group consisting of:
  (a) CDR 1 of SEQ ID NO: 376, CDR 2 of SEQ ID NO. 377 and CDR 3 of SEQ ID NO. 378; and
  (b) CDR 1 of SEQ ID NO: 387, CDR 2 of SEQ ID NO. 388 and CDR 3 of SEQ ID NO. 389.

6. The nucleic acid of claim 1, wherein the second binding domain comprises an antibody variable domain as shown in SEQ ID NO: 375 or 386 or an amino acid sequence at least 80% identical to the amino acid sequence of SEQ ID NO: 375 or 386.

7. The nucleic acid of claim 1, wherein the bispecific single chain antibody molecule comprises a sequence selected from:
  (a) the amino acid sequence of SEQ ID NO: 380, 382, 384, 391, 393 or 395;
  (b) an amino acid sequence encoded by the nucleic acid sequence of SEQ ID NO: 381, 383, 385, 392, 394 or 396; and
  (c) an amino acid sequence at least 85% identical to the amino acid sequence of (a) or (b).

8. The nucleic acid of claim 1, wherein the second binding domain comprises one antibody variable domain or two antibody variable domains.

9. The nucleic acid of claim 1, wherein the second binding domain comprises a VHH domain.

10. The nucleic acid of claim 1, wherein the tumor target antigen is EGFR, CD44v6 or CD30.

11. A nucleic acid comprising a polynucleotide encoding a bispecific single chain antibody molecule comprising a first binding domain, which binds to an epitope of a human CD3 epsilon (CD3ε) chain, wherein the epitope is part of the amino acid sequence set forth in SEQ ID NO: 2, 4, 6, or 8, and a second binding domain consisting of one antibody variable domain that is cross-species specific and binds to an epitope of a human and a non-chimpanzee primate tumor target antigen, wherein the first binding domain is a VHH domain and comprises CDR 1 of SEQ ID NO: 398, CDR 2 of SEQ ID NO: 399 and CDR 3 of SEQ ID. NO: 400.

12. The nucleic acid of claim 11, wherein the first binding domain further binds a non-chimpanzee primate CD3ε chain.

13. The nucleic acid of claim 11, wherein the first binding domain further binds a *Callithrix jacchus, Sanguinis oedipus* or *Saimiri sciureus* CD3ε chain.

14. The nucleic acid of claim 11, wherein at least one of said first or second binding domain is CDR-grafted, humanized or human.

15. The nucleic acid of claim 11, wherein the first binding domain comprises an antibody variable domain comprising:
  (a) the amino acid sequence of SEQ ID NO. 397;
  (b) an amino acid sequence encoded by the nucleotide sequence of SEQ ID NO: 401;
  (c) an amino acid sequence at least 80% identical to the amino acid sequence of SEQ ID NO: 397 or the amino acid sequence encoded by the nucleotide sequence of SEQ ID NO: 401; or
  (d) an amino acid sequence at least 90% identical to the amino acid sequence of SEQ ID NO: 397 or the amino acid sequence encoded by the nucleotide sequence of SEQ ID NO: 401.

16. The nucleic acid of claim 11, wherein the antibody variable domain of the second binding domain comprises CDR1-3 selected from the group consisting of:
  (a) CDR 1 of SEQ ID NO: 376, CDR 2 of SEQ ID NO. 377 and CDR 3 of SEQ ID NO. 378; and
  (b) CDR 1 of SEQ ID NO: 387, CDR 2 of SEQ ID NO. 388 and CDR 3 of SEQ ID NO. 389.

17. The nucleic acid of claim 11, wherein the second binding domain comprises an antibody variable domain as shown in SEQ ID NO: 375 or 386 or an amino acid sequence at least 80% identical to the amino acid sequence of SEQ ID NO: 375 or 386.

18. The nucleic acid of claim 11, wherein the bispecific single chain antibody molecule comprises a sequence selected from:
(a) the amino acid sequence of SEQ ID NO: 380, 382, 384, 391, 393 or 395;
(b) an amino acid sequence encoded by the nucleic acid sequence of SEQ ID NO: 381, 383, 385, 392, 394 or 396; and
(c) an amino acid sequence at least 85% identical to the amino acid sequence of (a) or (b).

19. The nucleic acid of claim 11, wherein the second binding domain comprises one antibody variable domain or two antibody variable domains.

20. The nucleic acid of claim 11, wherein the second binding domain comprises a VHH domain.

21. The nucleic acid of claim 11, wherein the tumor target antigen is EGFR, CD44v6 or CD30.

22. A vector comprising the nucleic acid of claim 1.

23. A vector comprising the nucleic acid of claim 11.

24. A host cell comprising the vector of claim 22.

25. A host cell comprising the vector of claim 23.

26. A process for producing a bispecific single chain antibody molecule comprising a first binding domain which binds to an epitope of a human CD3 epsilon (CD3ε) chain, wherein the epitope is part of the amino acid sequence set forth in SEQ ID NO: 2, 4, 6, or 8, and comprises at least the amino acid sequence Gln-Asp-Gly-Asn-Glu (QDGNE; SEQ ID NO: 430), and a second binding domain comprising an antibody variable domain that is cross-species specific and binds to an epitope of a human and a non-chimpanzee primate tumor target antigen, wherein the first binding domain is a VHH domain and comprises CDR 1 of SEQ ID NO: 398, CDR 2 of SEQ ID NO: 399 and CDR 3 of SEQ ID. NO: 400, the process comprising culturing the host cell of claim 24 under conditions allowing the expression of the bispecific single chain antibody molecule and recovering the molecule from the culture.

27. A process for producing a bispecific single chain antibody molecule comprising a first binding domain, which binds to an epitope of a human CD3 epsilon (CD3ε) chain, wherein the epitope is part of the amino acid sequence set forth in SEQ ID NO: 2, 4, 6, or 8, and a second binding domain consisting of one antibody variable domain that is cross-species specific and binds to an epitope of a human and a non-chimpanzee primate tumor target antigen, wherein the first binding domain is a VHH domain and comprises CDR 1 of SEQ ID NO: 398, CDR 2 of SEQ ID NO: 399 and CDR 3 of SEQ ID. NO: 400, the process comprising culturing the host cell of claim 25 under conditions allowing the expression of the bispecific single chain antibody molecule and recovering the molecule from the culture.

\* \* \* \* \*